United States Patent 11,446,398 (REGULATED BIOCIRCUIT SYSTEMS) - sequence listing, part 43

SEQ ID NO: 131584 - DNA, 5036 bp, Homo sapiens
  Payload ID: 5678
  Gene Symbol: ERI1
  Gene Name: exoribonuclease 1
  Uniprot ID: Q8IV48
  ENST ID: ENST00000523898
  CDS Start-End: 680-1729
ttgttctttcctggccttgtggagtttcacgttttttattcagttaaagattcaaggtactcctaagcagatttctgaagctctttttccatgtaattccctcctctccagaattctgccctacaaattccaaccgacttggcctaccccaatttcgtcaactccaatctctgtcttttcaacccaggagatcctaggtttccatatgatttcctttcatcgcaccacagactggaaatcgcctctgggcaaaagggcaggatgatatacggctccttttatttcttttctctcaggaaacactgacgggaacacacgtgccggtgctaccctccagtgactggactagatccttgcgcaacttcaacccgcgctagctccgcctacggccggccacgccccgtcttctcaccggcgcgcctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacaataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggctgctgcctatttttgtatggcctacaaactatggtttttatattcccttttgttaatggctcaaaataatattttgtataatacgaaaattacgaaattttagtttctctaaataaagttttggaaagaacta

SEQ ID NO: 131585 - DNA, 2107 bp, Homo sapiens
  Payload ID: 5678
  Gene Symbol: ERI1
  Gene Name: exoribonuclease 1
  Uniprot ID: Q8IV48
  ENST ID: ENST00000519292
  CDS Start-End: 221-1270
cgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggctgctgcctatttttgtatggcctacaaactatggtttttatattcccttttgttaatggctcaaaataatattttgtataatacgaaaattacgaaattttagtttctctaaataaagttttggaaagaa

SEQ ID NO: 131586 - DNA, 828 bp, Homo sapiens
  Payload ID: 5678
  Gene Symbol: ERI1
  Gene Name: exoribonuclease 1
  ENST ID: ENST00000520684
  CDS Start-End: 136-435
agtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactaggtacaacttgtagcctacagaagattttccgagcaaaatttttgtccttcccaggtgtgaagatcagttgcttactcctggcttgcgtgggagctagcgatctagataggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatc

SEQ ID NO: 131587 - DNA, 536 bp, Homo sapiens
  Payload ID: 5679
  Gene Symbol: EXOSC1
  Gene Name: exosome component 1
  ENST ID: ENST00000370884
  CDS Start-End: 1-497
gttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggttgaaatttataagagtttccgcccaggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttc

SEQ ID NO: 131588 - DNA, 718 bp, Homo sapiens
  Payload ID: 5679
  Gene Symbol: EXOSC1
  Gene Name: exosome component 1
  ENST ID: ENST00000370885
  CDS Start-End: 9-521
cggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccaggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatctttt

SEQ ID NO: 131589 - DNA, 741 bp, Homo sapiens
  Payload ID: 5679
  Gene Symbol: EXOSC1
  Gene Name: exosome component 1
  ENST ID: ENST00000370886
  CDS Start-End: 4-540
atcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaagatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaag

SEQ ID NO: 131590 - DNA, 923 bp, Homo sapiens
  Payload ID: 5679
  Gene Symbol: EXOSC1
  Gene Name: exosome component 1
  Uniprot ID: Q9Y3B2
  ENST ID: ENST00000370902
  CDS Start-End: 33-620
gttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccaggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaactgtgatattggaaatagcctatccctcctgacagtccttataaatacatattttttgctatgataaaacttttttactaaaagga

SEQ ID NO: 131591 - DNA, 480 bp, Homo sapiens
  Payload ID: 5679
  Gene Symbol: EXOSC1
  Gene Name: exosome component 1
  ENST ID: ENST00000477692
  CDS Start-End: 1-431
caggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgttggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataa

SEQ ID NO: 131592 - DNA, 564 bp, Homo sapiens
  Payload ID: 5679
  Gene Symbol: EXOSC1
  Gene Name: exosome component 1
  ENST ID: ENST00000485122
  CDS Start-End: 1-420
atggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaa

SEQ ID NO: 131593 - DNA, 2721 bp, Homo sapiens
  Payload ID: 5680
  Gene Symbol: EXOSC10
  Gene Name: exosome component 10
  Uniprot ID: Q01780
  ENST ID: ENST00000304457
  CDS Start-End: 39-2621
gacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagccggtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgatcagcaaccgctggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 131594 - DNA, 2808 bp, Homo sapiens
  Payload ID: 5680
  Gene Symbol: EXOSC10
  Gene Name: exosome component 10
  Uniprot ID: Q01780
  ENST ID: ENST00000376936
  CDS Start-End: 51-2708
gtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagccggtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgctggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 131595 - DNA, 622 bp, Homo sapiens
  Payload ID: 5680
  Gene Symbol: EXOSC10
  Gene Name: exosome component 10
  ENST ID: ENST00000460196
  CDS Start-End: 24-398
gacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgtagagacggggtttcaccgtgttagccaggatggtctcgatctcctgaccttgtgatccgcccgcctcagcctcccagaatgctgggattacaggcgtgagccaccacacccggccttcccttactcttatgggtattttactggatgaagcctcaggtgtaaacaagaatcaacagcctgtcctccctgccggcttgcaggtccccaaaacggtagtgtccagctg

SEQ ID NO: 131596 - DNA, 606 bp, Homo sapiens
  Payload ID: 5681
  Gene Symbol: EXOSC2
  Gene Name: exosome component 2
  ENST ID: ENST00000372350
  CDS Start-End: 6-606
ccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaaacccactttcatgatttgccatgtggtgcctcagtgattctcggtaacaacggcttcatctggatttacccaacacctgagcacaaagaagaggaagcagggggct

SEQ ID NO: 131597 - DNA, 1885 bp, Homo sapiens
  Payload ID: 5681
  Gene Symbol: EXOSC2
  Gene Name: exosome component 2
  Uniprot ID: Q13868
  ENST ID: ENST00000372351
  CDS Start-End: 7-798
gccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagagaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaa

SEQ ID NO: 131598 - DNA, 1957 bp, Homo sapiens
  Payload ID: 5681
  Gene Symbol: EXOSC2
  Gene Name: exosome component 2
  ENST ID: ENST00000372352
  CDS Start-End: 13-870
attggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaagtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaa

SEQ ID NO: 131599 - DNA, 2040 bp, Homo sapiens
  Payload ID: 5681
  Gene Symbol: EXOSC2
  Gene Name: exosome component 2
  Uniprot ID: Q13868
  ENST ID: ENST00000372358
  CDS Start-End: 72-953
ggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaa

SEQ ID NO: 131600 - DNA, 709 bp, Homo sapiens
  Payload ID: 5681
  Gene Symbol: EXOSC2
  Gene Name: exosome component 2
  ENST ID: ENST00000495699
  CDS Start-End: 1-709
gaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcag

SEQ ID NO: 131601 - DNA, 1956 bp, Homo sapiens
  Payload ID: 5681
  Gene Symbol: EXOSC2
  Gene Name: exosome component 2
  Uniprot ID: Q13868
  ENST ID: ENST00000546165
  CDS Start-End: 33-836
gagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatg

SEQ ID NO: 131602 - DNA, 1806 bp, Homo sapiens
  Payload ID: 5682
  Gene Symbol: EXOSC3
  Gene Name: exosome component 3
  Uniprot ID: Q9NQT5
  ENST ID: ENST00000327304
  CDS Start-End: 14-841
ggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggccaagtcttattttgctaaaatcatttcctaggagctaagcatagaaaactcttctatgctatttagtatattaaccaaaacctttagaggtaaagagactgccaggtgatccacatcagtgattcttggtttctagacctctgagaatatgtgagatacagatcccctgaagcctatccatagaaagtcctttttggatcaaagagattatagaactctatttgttgataaagaccaa

SEQ ID NO: 131603 - DNA, 768 bp, Homo sapiens
  Payload ID: 5682
  Gene Symbol: EXOSC3
  Gene Name: exosome component 3
  Uniprot ID: Q9NQT5
  ENST ID: ENST00000396521
  CDS Start-End: 21-515
ggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccattt

SEQ ID NO: 131604 - DNA, 1625 bp, Homo sapiens
  Payload ID: 5682
  Gene Symbol: EXOSC3
  Gene Name: exosome component 3
  Uniprot ID: Q9NQT5
  ENST ID: ENST00000465229
  CDS Start-End: 18-512
gtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcggggtctggctgtgttacccaggctggagtgcagtggtacaatcatagctcactacagcctcaaattcctgggctcaagtgatcctcctacctcagcctcctgagtagctgggactacaggtacaggccaccatacctggctaatttttaattttttagaggcagggtcttcctatattgcctaggctagtcttgaactcctggcctcaagtgatcctcttgcctcggcctcccaagatgctgggattatatgcaggagccactgtgcccagcctaatagtagggaattcttggttaacattttcagaggactagagttagaagtttcaggtaggaacctcagatctgcagttttcctaacttatctgaaaaatatgcaaacactagcacataaaacagatgtctaaaaagagagtttacaatttacatactgtgatgtaaggcctaaaattaaggcccagtattatgcactgccttgacatctgtcaaaactgggaatacttcaaatagcctaatagtaagctcccctc

SEQ ID NO: 131605 - DNA, 887 bp, Homo sapiens
  Payload ID: 5683
  Gene Symbol: EXOSC4
  Gene Name: exosome component 4
  Uniprot ID: Q9NPD3
  ENST ID: ENST00000316052
  CDS Start-End: 104-841
acctccggaaaccgtagattccgggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacac

SEQ ID NO: 131606 - DNA, 606 bp, Homo sapiens
  Payload ID: 5683
  Gene Symbol: EXOSC4
  Gene Name: exosome component 4
  ENST ID: ENST00000525936
  CDS Start-End: 82-552
gggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgc

SEQ ID NO: 131607 - DNA, 1065 bp, Homo sapiens
  Payload ID: 5683
  Gene Symbol: EXOSC4
  Gene Name: exosome component 4
  ENST ID: ENST00000527954
  CDS Start-End: 281-1065
tgcttagcgcatgagtgtgggagctctgctttccaggcggagggaaccagaagggcgaagaccacggtggtgaaaacaagcaaggcacttatgcagagcagaaagactgctggtggggaaagaggggataactccaaatcaggttgagggttcccggggaggtgaggacttagggttttgtagagtagggaaatgatttgggatcttatttcatatgtaatgtgaaacctttgtaaggtagttaggatttgagtgtgtaggtgagacagaagcagcgttgatgtttgtaaacttgggttggcagggaatggggcaaggatggacacaaggaagccaattaaaaggtgccagagggcgacacatgcaagacagagagcgcaaaacagggggctttgttttggaggtaacgcagttgccccttgctgaggcattgaaagtggagggagaggcagacccacagaggacagtggagtgtgagctggaaggagtgggcctggctcatgtgtctgtcctcttccagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggc

SEQ ID NO: 131608 - DNA, 1118 bp, Homo sapiens
  Payload ID: 5684
  Gene Symbol: EXOSC5
  Gene Name: exosome component 5
  Uniprot ID: Q9NQT4
  ENST ID: ENST00000221233
  CDS Start-End: 152-859
ggcggagccagattgttggtaaacgctaagccacgtgcggacgcccaggaggatggcccagcccggcgcgtgcgcactggttacgcagcctgtttgcggcgcgcgctgccaggcggaagtgacaactgcagccgcacgtgggctcggcgcgatggaggaggagacgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcactttaa

SEQ ID NO: 131609 - DNA, 826 bp, Homo sapiens
  Payload ID: 5684
  Gene Symbol: EXOSC5
  Gene Name: exosome component 5
  ENST ID: ENST00000596905
  CDS Start-End: 15-608
gtgggctcggcgcgatggaggaggagacgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctca

SEQ ID NO: 131610 - DNA, 404 bp, Homo sapiens
  Payload ID: 5684
  Gene Symbol: EXOSC5
  Gene Name: exosome component 5
  ENST ID: ENST00000593771
  CDS Start-End: 4-404
gcgatggaggaggagacgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctgcaggggtcagtggatggcagtcaggccttgccttcttcccactggaatcttccatcatccctgcaggtgttgcagagaagagccgggagcggctgatcaggaacacgtgcgaggcggtggtgctgggcacgttgcaccc

SEQ ID NO: 131611 - DNA, 354 bp, Homo sapiens
  Payload ID: 5684
  Gene Symbol: EXOSC5
  Gene Name: exosome component 5
  ENST ID: ENST00000602129
  CDS Start-End: 1-189
ggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcacttt

SEQ ID NO: 131612 - DNA, 5153 bp, Homo sapiens
  Payload ID: 5685
  Gene Symbol: EXOSC6
  Gene Name: exosome component 6
  Uniprot ID: Q5RKV6
  ENST ID: ENST00000435634
  CDS Start-End: 31-849
gcggaaggggttcgcacgccaagaaccgccatgcctggggatcaccgccgcatccgcggccctgaagaatcgcagccgccgcagctgtacgcggccgacgaggaggaggcgcccggcacccgcgacccaacgcggctacggcccgtgtacgcgcgcgccgggctgctgagccaggccaagggctcggcctacctggaggcgggaggcaccaaggtgctgtgtgccgtgtcgggcccgcgacaggccgagggcggcgagcgcggcggcggcccggccggagcaggcggcgaggccccggccgcgctgcgcggtcgcctgctctgcgacttccgccgcgcacccttcgcgggccgccggcgccgcgctcccccgggcggctgcgaggagcgtgagctggcgctggcgctgcaggaggcgctggagccggctgtgcgcctgggccgctacccgcgcgcgcagctcgaggtgtcggcgctgctgctggaggacggtggctcggccctggccgccgcgctcaccgccgccgcgctcgccctggccgacgcgggcgtggagatgtacgacctggtggtgggctgcggcctcagcctcgcgccggggcccgcgcccacctggctcctggaccccacgcggctcgaggaagagcgcgccgccgccggcctcaccgtggcgctcatgcctgtgctgaatcaggtggccgggctgctgggcagcggcgagggcggcctgacagagagctgggcggaggccgtacgcctgggcctcgagggctgccagcgcctctaccccgtgctgcagcagagcctggtgcgggccgcccgccgcaggggcgccgccgcccagccctgaaccagaagcctgagcaactacggacgcaagccgaggaccgtgctgccgccgtccacgaaaagacccgcgccatcggcctccagtttgcgtcgagaattcctggaagggccctgatatgactgtggttggactgacctgactgccagatggtgggacttggtctggagcagggactacttggaatgataaaggcaaaactcaacagcccctggagctgcgcttgtggtggagctggaccctgaaattacctggaccttttttttagagacagggtttctttctgcagtctcaaactcctagccttgattgatcctcctgccttggcctcccaaagtgctgggactacaggtgcatgcaaccacacctggctaattttcttttcttctttctttcttttttttttttttttttttttgatggagtcttgttctgttgcccaggctggagtgcaatggtgcaatcttggctcactgcaacctctgcctcctgggttcaatccattctcctgcctcagcctcccaagtagctgggattacaggcacatgcctccataccgggctaatttttgtatttttagtagagatggggtttcgccatgtgggccaggctgttctcgaatgcctgacctcaggtgatccacccgccttggcctcccaaagtgctggaattacaggtgtgagccactgtgcccagctgagtaaatttcttgattgcacagaatgtacggtgatattggcggacttaaggacatcgaattgtttatcaggaataaagtattatgtgtgttttctgcggccctggataatgctgtagcattcagggtcgattgagtaaaaaaaatgtagagatggtttcctgtttgtttttgcttctagttttcattcatttgctatttattctcttctggctttgcttgtgtatgcatatatataaaaccattattattattattattatttttagtttctagtggaaggcttttatttggttctgtgaatagtcattttgtttcctaagaacttccagcaagttgtattcattccattcatctagaattcctaggctgcctttgtcgggcctgcaggtattaatggagaatagcagctttttatttttttatatttattttttgagacagagtctcactctgttgcccaggctggagtgcaatggcgcgatctcagctcactgcaacctccgcctcagaggttcaagtgattctcctgcctcagcctctggaatagctgggactacaggcacctgccaccacacccagctaactttttgtatttttagagaagatggggtttcatcatgttggccaagctggtctcaaactcctgatctcagtgatccatctgcctcagcctcccaaagttataagatttttttcctctggtttttagtaaatgttttttttgagattgcttagcaccagaatgatttgcaaatttgaaaataggaactccactaggaatgccggatagaagagtgcttcacatttgtagagggagacaagaactaaatatcacgacgtctttctgagccttttggtttgctaacgtgccccaaattcttattccaaacggtataagataattatgtgtaaatgaataccagctctacttagttttatttcatatttgtgtatctgaatatattaaaatatcttttttttttttttgatgcggagtcttgctctgttgtccagcctggagtgcagtggcatgatctcggctcactgcaacctctgcctcccaggttcaagcgattctcctgcctcagcctcctaagtagctggtattacaggagtgtgccattagcctggctaatttttgtatttttagtagagatggattttcattgtgttggccatgctggtcttgaactcctgacctcaagtgatcctcctgccttggcctcccaaagtactgtgattactatcatgagccaccacacctggcctaaaagatcattgatttagttttgagtaagattttaagtgattaaattatggtattgttgtgtctggaatatctgatattagggttttttttttttttttttacagtttttgatatgctttattttgggtatgtagtttacaaaatataaaggaaatataaggagtgttctcttttttttttaaataaaaagtgtatttttaactgggcatggtggctcactcctgtaaccccagcactgtgggaggctgaggctggtgaatcgcctgagtccaggagtttgagaccagcctgggcaacaaggtgaaaccctgtttctatcaaaaaaaaaaaaaaaaaaaaaaaaggaaaaaaaataagtcaggcatggtggtatgcacctgtagtcccagctacttgaaggctgaggcaggaggatcgcttgtgcctgggaggttgaagctacagtgagctatggtcaagctactgcactccattataggcaaccctatctcaaaaaagcaaagcaaaacaaaacatttttccccttgattatagaggtttgagaaaaatttgagggaagattcagaaaattacctgtaactgaacagaatgccaccagcttgggcttattctgcatgcataattatgaacattttcccagctcttgtgaaaattctcacattcatagaaagatagatgcaccagtaaaataaatacctgtaaatacgataataatttcataataatatgcttcacctagatttaccagttactaatattttgccagttttattttctcacacacttttgttgagcatctgaaaaccatacacatgatgacagttcaacccataatgttttagtttgcatctcccaagaataaggtttttcttctgtataacaagaatattgtaatcatacctaagaaaatgaattttattacatatgtgttctatattcaaatttctgtaattacccctaagatgtcttttaaatgatttttagcattgatagtctgtgcctgtgtagattataacattggctattgcaaaataatggttttctttttctctttttttttgagacgaaatcttgctctattgtccaagctggagggcagtggcacaatctcggctcactgcaacctccgcctcccaggttcaagcagttctcatgcttcaccctcctgagtagctgggattacaggcaggtgccactgtgctctgctaatttttatatttttagtagagacggagtttcatcgagctggccagactggtcttgaactcctgacctcaagtgatccacctgcctcgtcctcccaaagtgctggggttacaggtgtgagccactgcacccagcctaaaatgatggttttctgattctagcatttcttttataagattgctatgtaaagcacagcttttctttttttagggaaaaatgtcttttaacagctgcaaaataaatattctttcaatggaatgacaattattatttttgccatatatttattttaaaaatttatgtataatggtaacctgagcctgcatgttattcatgtgtggtgccatactgatctttaattttaatgtgaagcaagtactaatatagtaaagcataaattatataaaatttgctttatattttggattgcaaattaattgctgtactttatagaaaagtttcccaaatccgttttacttttttgtatttgaaatttaatcacaggtggaatcttaaagagagcatttagggatattgtaaacagatgttattaaggactaatgttaacaaacattgaagaagagaaaacagtatttgtttttagcttaacatcttagtggagtgaaatattttcagtatatttattttatttatttattaattatttttttttttgagatggagtctggctgtattgtccaggctggagtgcagcggtgcaatctcagctcactgcaacctctgcctcctgggttcaagcgattcttgtgtctcagcctcccgagtagttgggatttacaagtcaattttttttttaactaaaactacagaatctatttttcttggtctcatactcagttttttatgtagtcacttagtaaataacctaatttgcttgttttctccacactaattttagggtgaattcctcatttcgcttttcagatcatggggtgagggggatggttgtgtgtgtgaggaactgaggaatcagatggaaaacaatgcctctgctcctttgagtataatcagtgatatttgaggttccagggttaaatgctgcatttttatttctgacgttcgtaccttaaaatatttgaagaaaataaactatttcattgttgtcagaaa

SEQ ID NO: 131613 - DNA, 1055 bp, Homo sapiens
  Payload ID: 5686
  Gene Symbol: EXOSC7
  Gene Name: exosome component 7
  Uniprot ID: Q15024
  ENST ID: ENST00000265564
  CDS Start-End: 49-924
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttgtgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggt

SEQ ID NO: 131614 - DNA, 694 bp, Homo sapiens
  Payload ID: 5687
  Gene Symbol: EXOSC8
  Gene Name: exosome component 8
  ENST ID: ENST00000239893
  CDS Start-End: 24-137
ggcgcagacgcgcgggcgggaagatggcggctgggttcaaaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaacc

SEQ ID NO: 131615 - DNA, 1198 bp, Homo sapiens
  Payload ID: 5687
  Gene Symbol: EXOSC8
  Gene Name: exosome component 8
  Uniprot ID: Q96B26
  ENST ID: ENST00000389704
  CDS Start-End: 266-1096
agtcacagcaccagctcttttataaagagggagacccgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcggcgcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaa

SEQ ID NO: 131616 - DNA, 524 bp, Homo sapiens
  Payload ID: 5687
  Gene Symbol: EXOSC8
  Gene Name: exosome component 8
  ENST ID: ENST00000481013
  CDS Start-End: 1-210
gtctgggttctatactgtgatctcatttgcctcgactacgatggaaacattttggatgcctgcacatttgctttgctagcggctttaaaaaatggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactca

SEQ ID NO: 131617 - DNA, 1481 bp, Homo sapiens
  Payload ID: 5688
  Gene Symbol: EXOSC9
  Gene Name: exosome component 9
  Uniprot ID: Q06265
  ENST ID: ENST00000243498
  CDS Start-End: 109-1428
gatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattcca

SEQ ID NO: 131618 - DNA, 1529 bp, Homo sapiens
  Payload ID: 5688
  Gene Symbol: EXOSC9
  Gene Name: exosome component 9
  Uniprot ID: Q06265
  ENST ID: ENST00000379663
  CDS Start-End: 106-1476
gacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagagctggggtttcaccatgttggccagactggactcgagttcctgacctcagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattcca

SEQ ID NO: 131619 - DNA, 733 bp, Homo sapiens
  Payload ID: 5688
  Gene Symbol: EXOSC9
  Gene Name: exosome component 9
  ENST ID: ENST00000511454
  CDS Start-End: 101-361
aattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatatt

SEQ ID NO: 131620 - DNA, 757 bp, Homo sapiens
  Payload ID: 5688
  Gene Symbol: EXOSC9
  Gene Name: exosome component 9
  ENST ID: ENST00000509800
  CDS Start-End: 80-757
gagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaagtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgac

SEQ ID NO: 131621 - DNA, 3882 bp, Homo sapiens
  Payload ID: 5688
  Gene Symbol: EXOSC9
  Gene Name: exosome component 9
  ENST ID: ENST00000513654
  CDS Start-End: 103-831
gtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaaggtaggtgacactttatggcacacttactatatattacatacatatagtattaccgtatagttatatatataatgcataaaatgtgtgtatatttatattatcactgtatatagtaatatatagcatattagctatatagagatgtatagtggataaataacatacaggatactatatagagagaatatagatatgtagttatatatagggatgtaagtattgcatttttagaggggctaaatattgtgatttaaatttcaactaaattattgtggctagctgcaatactaatgctactttctaaaagaatatgcatatctttgtagagtagtggaacactggcataaatgatagtgatatttttaattaaaaaaattttgtgtgtgtgtatgtatgtgggtgggttttaagggaatgagtttcttgaagatcttattcctccctgctgtctttttttttgtagtttctagactgaaacaaaaagcccatcccatatcataacatataatactgcctaaataaaactttctatgatgatagaaacattaagtatctacactggtatagcagccactagccccacatggctagtgaacacttgaaatgtggcttgtgttactgagaactgaattttaaattttacttaatacaaaattaagcagccacatgtggctagtggctaccatgctagacatcgcagtattagaacataaaaaaattctataagtaactagaatactggtagtcctagacgtttcttgcattctgaaagccatagaactgaagttgttatgtatggttatttctactttttaaaaaaagcaaattcttgctggtctatataatagaatgacttattttcttacgtggtaagaacagaaatcctacaaggaactgggagctaggctggcagggaaaattgaaggtgatgtgtttaataggaatgtaatgcaaatacttctgttttcaaagagagaaattattgcttatgaacattactggagcctgggctttttgtttttttacttaagtaaataggtaaggaaaaaatttcccattgattgggacccttactcaaatttcccagtggttacttctatttggtattattcttccagaacttgttccaggtatttatttactctctgtgcagtgatgtaagctaatgctgcatatacttgtatagcattgaatataactagttggtttaacaattctcttattgttgaagatgtaagttgtttccattttctcactgttaatatccttgcacttgcatatacctcttatatgtttgtttagtgtattcttctaacagtgaataatattttcaactgaatataatgaaggtggacctaagcattggaaaaatggagcaggtacagccttcctaaagcatgtgaacaaagggagaaactaattgaaaactaaaaatacaaataattgatatgggttaattcacattttatgtatatcattaactaataagcaggagaaaaatgggcaaaatacatggagcagttctcaaagtatacaatggccagtaatatttttcatggtcagccctgacagtaatacaaataaaatccaaagaaaaatgacatggcattttttgttactgtattttgggcagtattaaaaacaccagcaatgccaaaggtatatgggaaatgggttcttttatttcttggaatgtaaactggaactatttctggaggaatagagtagcacaaacaattcagttgtctctacaaaagatgctatatacatttccccctagcttttctattatgacatgtaccaaattgtcacaccattcaagcacctgtaggaaataagagtttaaagaaacaaatgttacagatgagttctagagtgctctaagaagctgatttaaagaaaagattaagcctccacctagagttttatttttattttttgggatggagtcttgctctgtcacccagactggagtgcagtggcactgcaacctccacctccatgggttcaagcgattctcatgcctcagcctcgagtagctgggcctacaagcacatgccaccacgcctggctaatttttctattatttttaatagagctggggtttcaccatgttggccagactggactcgagttcctgacctcaggtaatccacctgcctcagcctaccaaaatgtgggtattaaaagtgtgagccaccacgcccagccccagaaataagagtttagaacgtctgatagaaataaattcatgtagaaataaattttgcaagagattgcttaacttttttttttttttttaaattaataaaaaaacaaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagca

SEQ ID NO: 131622 - DNA, 515 bp, Homo sapiens
  Payload ID: 5688
  Gene Symbol: EXOSC9
  Gene Name: exosome component 9
  ENST ID: ENST00000511132
  CDS Start-End: 1-515
ctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaagtgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaag

SEQ ID NO: 131623 - DNA, 1543 bp, Homo sapiens
  Payload ID: 5688
  Gene Symbol: EXOSC9
  Gene Name: exosome component 9
  ENST ID: ENST00000512454
  CDS Start-End: 217-1488
cgaccggcacgttcaccccatccctcaggctttatttattttttttcgacaggttcttttcaaggctccagtcaccgcagcagttgtccatgctgtagtttccactttcctgtatgggcgggctggttaggattccactttcccccaagtgcttagcccagggccagacaaaaagtagttgcttaagaaatacttgttgaaggaataaattaatgaatgaatttgtgcttacagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccatt

SEQ ID NO: 131624 - DNA, 8270 bp, Homo sapiens
  Payload ID: 5689
  Gene Symbol: EXT1
  Gene Name: exostosin glycosyltransferase 1
  Uniprot ID: Q16394
  ENST ID: ENST00000378204
  CDS Start-End: 808-3048
gtgtaagtgtaacattcagaaccgggtaacattcggcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaattgtgttggttgtgaatatttcaaagctgctattccttttcccacagacatcattgtcatggccatgtagggtgccctgcagtttcaaaagctcaaacttcgtggaaaacacaataagtcactctacccattatcaagaaataactgagcataagttgtaacttcattattcaactttgccagtgcaaattgttttccacttcgaatcttcaaatccacttgaacttttatctctaaaatgtcgctgcatgaaagaaagtattacgacttccaggtaggcagttctaactgaaatctctatgtttgagatagatatatatgataatcgtttttcattgggggggtggggggaattagtaccaagaaaacactagtataattaagaaatgttcagtttgcacaaagaactatccagataacccaccagcatgttagtgagatggaaatacagacccacaacagtaacccaatacttgcaggggttgggggcacggttatagattcaaccattgacctaagtctgcgtagcactgggaagaggctttggtttagaagccaaggaataatgagtatattggggagaacagattatttacaagatgaactctttaatgtttgtgagaatctcaagtttcagagtttctcttttgagaaagaaaaaggggtaataaggtagaaattcacaccaatgaacaagaggattgctgcaaagtaactgaggagatgtctcgccattgggaccctaatgccatttttggtcaaacattgttttgagcaagaatctggcaaacaaaataatcaacaacaaatgtgaatatagtttcatttacttttaatttttaaatctgtggaaaagtttagttgtgcttcttgttaaaaagaacatttctatccctgaaaatgctatcttgggcttatgattattgttaaactccaagtataaactgaaaaaaaaaacatatccctaactctgttatgaaaaatggagacttctgatattaaatgctttcttctacttggaagaggccagagaaaacagggaagagaaagacattattgagtttgaccatgtattatgctgaataaacaataagcactttagagtccctccctcaaactctcatacatttcatatttcttttccatttattttcagttttgttttagaagaaaagttcatcagagaattttgttctgataatttcaagtggccatcttaggtcagtggaaaccgtaagtccattggactttacctcatcctttctttgtagacatctgggagaggaagaggagcttgtaatgatagcacggggatggtgctgtaaacaggagtgaaagtgtttgtggaagtccagagaagtgactcaacaggctacctagctgcagaacaaggagtagagcccacatatccagatggtgttttgagaggtgcgtagacagtgaaattcaattaaagagaggattttctcctcagcctcatgactcagaacagctccctaaatacctctctcatctaattggacccatccatagtccattctcaaacatgtgacattttcccctaagtagatgtgattatctcttaggcatttgttgaaaaataattcttaggtccatggtgcttgcacttgtgtcttttctataaaatgtttggtcttacaggtttcatgtcatttaagctgcacttctcagcaagttaaaagattagcagttaatctttattcatttggcctttgtgaatttgtatttaaattatttttttcaggattggcaaattattcttgtttctcctttaccaaaaaataaatgcgatattttgttcaatgaccccaaaaccaacttgaaacttaggtggtcatattggcttgcaaagcaatgtccctaattgtaccagtcagtcacacaagtggattcaaggacctgctttgccagattgacctgtcaccaagctcacaacacatatcctccacaaacaacatgtgttatgtgaagaaaaatggtaattataaataagaacaggatataacacacctttcatccactttaaatctccacagtttcattttatgtcattctctgagcaaatctctttgggatgtgagctagcgtgttcttctcccatttggaatataaggctgggaatagaacaatgcttaacaaatcagtgaagctcgacagtaatatgtaattttaattcagttaggaaagagttgtattgcattgcaacaagttgacaaatcatagccatctctgtagggtgtcaggaattatctcctggtcaactttaatgataactaggggtccctaagtgggctaacatgtgctgcattggagagaagccaagggctgagagtacagtgccaaccacgtaatgaattgcttgcagaaattccaaagaggactcagccacttatggatttccacacagcatcttttcccagctccacattaagacacaggatcttaaaagtaattttttaaaagctggctgtgtatttatttatatgaaagtgttataaatatcaaagcttacaaatacattaatacatatcacctttgttgaagctagcaaaatggctcaaaattgagactgtagagaaaaatccatgaaataatcacgatagtcataccacaaaagatagcatagctaggtgggcctacctggtcgtatcaacacactttcagatagatgcttcaaaaaaaaagggaaagcttgttactggaatcttatgtgcattacagtttaatttcttcttgtgacaaatggtgctcaaagaaggatcaatccggttgcatccttcaatttcccttttagaatgacttttggttttcattacagtaggctatgttagcctttattttggtggttctcaaatacctggtgacttgaaagagtattatgctggtggcctttcataaaggttactgaactttaatcaggggtgagatgaatgaatgtgaataggcctatatactattttttttaattaaaaaaaaaaaaaacagggcacttgatttaagaacaaacctgtttaaagggcaggatcagggggaagacagccttactaggttggaatctgaatgagattcttgctggacaaggctgaattatggatgcaaaagccaagcaaacttcccagacctggaagtgtcttgtgttcccttgggtctcttgagatctccagtatttaaaagtagcagttattgccatgaactctcaaataaaaatgctcctgcctcttacttgtgaatataatcaacatgcagccagtacatcaggaccgcagttgctgaattcatttacctagttcccctttacagcgactatggacaagaacctttcagttggttttgtcattcttggccagatttaaccaagaaatttctttcactatcagcctcattttctcaggcatgcttacagggacaaagttgttttgagttgagttctcagcaaataagcattaatatcaaactgtgctaaacttgtctcacttggtataagaacttcagcataaagagattagtttatcctttgacaccaagtcttttttttttctttgagacagagtcttgccctgtcacccaggctggaatgcattggtgtgatctcagctcagtcactgcaacctccgcctccccggttcaagcaattctcctgcctcaccctgcttagtagttgggattacaggcatgtgctaccacactgggctaatttttgtatatttattagagacagggttttgctatgttggccaggctggtctcaaactcctgacctcaggtgatccacctgcctctgcctcccaaagtgctgagattacaggtgtaagccactgcgcctggccccccttttttttttctttaaaaaaaaaaaaaagcttgggggattaagtaccctaagatagtggtctctcccatcagttcaataatgctgtacagaacctctggataaaaaagctgttatttacaccataattgtgatgatggatttgactcctcaaaaccatctctcccctttttgccctttccaaaaatcaaaggcttttgtctccatgagttttacctagtagggattgtagttgtcactggtctagagttccaatacattttatatcaggaacctcagtgagctacccagaattggaacttaacatggcccagcaactaggagaagaaggcaaaccttgagaaagctgagccctcaggatagcacagtctcacccttgtttaaaatcaagtcaggctagcctttcagtcactctggttttgtaatgatttgccttttaggcctcaggccatttgatttctgcaatagttttctgttcttctcctacaggaatacatccctgtcctttcggttgtaactattactaaaactagggctatgcaaatgacctggttaccatgtaatgaaccttgtgtacttattttgagagaacaatatgtataggatatgttgaggggcagaaagaaagacatcaaaaactggaactattttaggtggcaaattgtaacgcaaaaaacaaaagtataccttattttgtatacgatgtacacttgggacagagttttctaatatgttgccaatgtttttgtagtgtcaccacaggtcttttctgaagtgtttttcccatttgttatagagtattaatgacttagcgtaattaagccctcaagtatgtgtgagagagcgcgtgtgagaaaatacaaagccatagatattgatttacttcactgacctgtgtaactttatgtctgggtttcgccatccaagatagattgttttatagagagtgtcaccaaagactttttccttccaatttatagaagaaaaaaaaaagaaattattaataaatgacatgacttttca

SEQ ID NO: 131625 - DNA, 700 bp, Homo sapiens
  Payload ID: 5689
  Gene Symbol: EXT1
  Gene Name: exostosin glycosyltransferase 1
  ENST ID: ENST00000436216
  CDS Start-End: 1-622
cggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagactcccatatctgtcggattagtcatatgttatggaggcaagcatgcagaaagagattccttctacaatcaggtctattcatcaggataaaatcctagcacttagacagcagacacaattcttgtgggaggcttatttttcttcagttgagaagattgtattaactac

SEQ ID NO: 131626 - DNA, 1446 bp, Homo sapiens
  Payload ID: 5689
  Gene Symbol: EXT1
  Gene Name: exostosin glycosyltransferase 1
  ENST ID: ENST00000437196
  CDS Start-End: 297-422
atgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctgg

SEQ ID NO: 131627 - DNA, 3424 bp, Homo sapiens
  Payload ID: 5690
  Gene Symbol: EXT2
  Gene Name: exostosin glycosyltransferase 2
  Uniprot ID: Q93063
  ENST ID: ENST00000343631
  CDS Start-End: 130-2286
agccacagggatctgattcctcccagggggatgtcctgcgcctcagggtccggtggtggcctgcggcatcccttgcggtgccagaagccgtgggacgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaata

SEQ ID NO: 131628 - DNA, 2997 bp, Homo sapiens
  Payload ID: 5690
  Gene Symbol: EXT2
  Gene Name: exostosin glycosyltransferase 2
  Uniprot ID: Q93063
  ENST ID: ENST00000358681
  CDS Start-End: 167-2353
ctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacagctcttcatggaaccagccaggagagagaactggtcagctgctaatcaccaaatgaactccctgatctggcctagggaacagtgggattcacagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttt

SEQ ID NO: 131629 - DNA, 3454 bp, Homo sapiens
  Payload ID: 5690
  Gene Symbol: EXT2
  Gene Name: exostosin glycosyltransferase 2
  Uniprot ID: Q93063
  ENST ID: ENST00000395673
  CDS Start-End: 57-2312
tcccttcctgctgccaccttcccgccagccacagggatctgattcctcccagggggatgtcctgcgcctcagggtccggtggtggcctgcggcatcccttgcggtgccagaagccgtgggacgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaatactgc

SEQ ID NO: 131630 - DNA, 3136 bp, Homo sapiens
  Payload ID: 5690
  Gene Symbol: EXT2
  Gene Name: exostosin glycosyltransferase 2
  Uniprot ID: Q93063
  ENST ID: ENST00000533608
  CDS Start-End: 335-2491
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattccttttt

SEQ ID NO: 131631 - DNA, 580 bp, Homo sapiens
  Payload ID: 5690
  Gene Symbol: EXT2
  Gene Name: exostosin glycosyltransferase 2
  ENST ID: ENST00000532479
  CDS Start-End: 434-580
gtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgagtgtctttaatgttatagagctactcagagttgctgtttctccttgagatgcttttggtgttggggaaccactgattcaagtatacacatagaccttgagagcttcttgggaagttctaacatgggccagcggagggcagctccttgcctgcatttgtcccaaaacttcctgtcttcaaactccaggagggatatgcagaatggcaaggaagccataccatagggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattct

SEQ ID NO: 131632 - DNA, 580 bp, Homo sapiens
  Payload ID: 5690
  Gene Symbol: EXT2
  Gene Name: exostosin glycosyltransferase 2
  ENST ID: ENST00000527014
  CDS Start-End: 244-580
gacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgagagctactcagagttgctgtttctccttgagatgcttttggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaa

SEQ ID NO: 131633 - DNA, 4015 bp, Homo sapiens
  Payload ID: 5691
  Gene Symbol: EXTL1
  Gene Name: exostosin-like glycosyltransferase 1
  Uniprot ID: Q92935
  ENST ID: ENST00000374280
  CDS Start-End: 868-2898
ccgactggagagggatgggaggagataccatagggtttggggggcttggcacagcggccctggcctctgcactgtgatagctccaagccagatggtgcaaggcagctgctgggctgcggggaagaggggctgcacttcctgagctggtgcagcggcagagtggataaggatcaggaccccgagccctcctggccctccaaggcagggggacaccggctgcacccaggctgtgacctcagctgacgccgatgatccacatgggatgcagggtctaattttagctccagccacaggggccacagcccagaagcgtctgccagcgggcacaggggcagccagggctgctcaggcaaggggaggagtgggaagaccagcccagctccctccagcctgtccctggccaagccgcctcctgtgggagctctgactggtccccatggcctggcagacagccctcctctcagttgagggcaaggtcaaggggtgcagccaggagggcagggggacacggccctgcattctggacaggggttgcgtcagccagagcagtgcccaggggcaggggtccctgctgggagggaaaaggctggcttggttgtccaaaggccgagaaggcagagtcctgagagcaggggggccaggccagcaagctgggtcccacctggcctcctcctgcctggctggtgactcactatctgaccttagacaggcggcctggtctcgatgggcctcagtcttcccatctgtacaatgacagcacaggactagcaggtcggtcccagctctggtctcccgccccaggccctgctcttcctgcttgctggcagaggcctcccagcttccctagccctgactgtgggtggccacatgcagtcgtggaggagaagaaagtccctgtggctggcactgtcagcctcctggctcctgcttgtcctgctgggaggcttctcccttctccgcctggcattgcctcccagacctcggcccggggcttcccaaggctggccccgctggctggatgcagagctcctgcagagcttctcccagcctggagagctcccagaagatgccgtttcacctcctcaagcccctcatggtggcagctgcaactgggaatcttgctttgatacctcaaagtgcaggggcgatggccttaaggtattcgtgtacccagcggttggaaccatctctgagactcatcgcaggatcctggcttccattgagggctctcgcttctacacattcagccctgctggggcctgcctcctcctcctcctcagcctggacgcccagactggagagtgcagctcaatgcctctgcaatggaacaggggcaggaaccatctggtcctccgtctccacccggctccctgccccaggaccttccagctgggacaggctatggtggctgaggccagccccacggtggactccttccggcccggctttgatgtggccctcccttttctccctgaagcccacccgttgcgaggtggggctcctggccagctgcggcaacacagcccccagcccggggtagccctgctagccctggaagaggagaggggtgggtggcgcacagcagacactggctcctctgcctgcccctgggatgggcgctgtgagcaagaccctggacctgggcagacccagcgccaggagacgctgcccaatgccaccttctgcctcatctctggccaccgtcccgaggctgcctcgcgcttcctccaagccctgcaggccggctgcatcccagtgcttctcagcccccgctgggagctgcccttctccgaggtcatcgactggaccaaggcagccatcgtagctgatgagaggctcccacttcaggtcctggctgccctccaggagatgtcccctgcacgggtcctcgccctgcgtcagcagacccagtttctatgggatgcctacttctcctcagtggagaaggtcatccataccactctggaggttattcaggaccggatttttggaacatcagctcacccctcactgctgtggaacagccccccaggggcactcctggccctgtctactttttccacaagcccccaggacttccccttctactacctgcaacagggctcccgccctgagggcagattcagcgccctgatctgggtggggcccccaggccagccccctctgaagctcatccaggcggtggcaggctcccagcactgtgcccagatcttggttctctggagcaatgagaggccactcccatccaggtggccggagacagctgtgcccttgacagtcattgatgggcacaggaaggttagtgatcgcttctacccatatagcaccatcagaacagatgccatcctcagcctcgatgcccgcagcagtctttccacaagtgaggtggactttgcctttctggtgtggcagagcttcccagagcggatggtgggcttcctgacgtcgagccatttctgggacgaggcccatggtggctggggctacactgctgagaggaccaacgaattctccatggttctcaccacagccgccttctaccataggtattaccacactctcttcacccactccctgcccaaggctctgaggaccctggcagatgaggcacccacctgtgtggacgtcctgatgaatttcatagtagcagcagtcaccaagctgccccctatcaaggtgccctatggcaagcagcgccaggaggctgctccactggcgcctgggggcccggggcccaggccaaagccgcctgccccagcccccgactgcatcaaccagatagcggcagcgttcggccacatgcccttgctgtcctctcgtctgcgtctggacccggtgctgtttaaggacccggtgtccgtgcagcgcaagaagtaccgcagcctggagaagccctaggggggcgacccgcggagaccccagcagaggtcgcagcccagctcccagggggcccggcgcctgccggcgggctccgctcttgggacaccggagaacctatcatgtcagccagcgggcccacacgtcggaccccggttggccaatcacaacaggggggcgtggccttaccttctcctgctcgccctcagccgcggagcctctgcggaggctgagccccgcgaccggagcgccgctctccgcttctccacccagctaacttctgctcgtctttcagagcattgtctcctccagggacttgcctggccctcctccccctccgcccccaatgggttcggtctcctttgcgctttcgcagtccagtgtttgccgcggttcccgcacggtcaggccccaggactggcttgcgagccccggggggcgggtcgtgtcgtgtccttttctctctggctaggcaggtgtgccgcaaatatttgacgaatagatggatggcagacattaactgcgtgcctggccctatgagggcggcggcgggacagggtgagcggagagacagaactgtccccgccccaccccgccacccattcctagggttcctagtcccgggaaggcaactacccaaagacgcctgggttgtcaggctcaatccttgagcctcaaccaaggagcagaggggtgcgggtaaacgaggagtggggcgaggaaagcgggatgggaacaagtggcctgtccccgcacggcccgcggctcagcctcggccgtctgccctgcactaccaaggccgaccactagaggtcagcgtcgcgccgcactcttcacccgcatgtccagagggcggccgggatgtggagggtgagcgctgtgggcagctcgggggctgaaagctgggaagagaaatctgaagaacagccccatctctttcgcctgcacacttggaactcagcaagaagggactgtttctaggtgggctgggcgcgagcagggactgtcccgagcggtataggtgagaatggagttggggggggacactaggtcctccggggttcacccacctggagctggaattatcacttccgaaataaagcgcgtgtccttgccccctcacgctccaggctataaa

SEQ ID NO: 131634 - DNA, 2835 bp, Homo sapiens
  Payload ID: 5692
  Gene Symbol: EXTL2
  Gene Name: exostosin-like glycosyltransferase 2
  Uniprot ID: Q9UBQ6
  ENST ID: ENST00000370113
  CDS Start-End: 288-1280
cactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcca

SEQ ID NO: 131635 - DNA, 3985 bp, Homo sapiens
  Payload ID: 5692
  Gene Symbol: EXTL2
  Gene Name: exostosin-like glycosyltransferase 2
  Uniprot ID: Q9UBQ6
  ENST ID: ENST00000370114
  CDS Start-End: 1438-2430
gggcgggatgagaaaggtgctggagctgttggagggacgccaggaggtggcaactaccagggggtgtgaggggctgacctgggatggaatcctgccacccggactcaggaagaaaatcctgaggtggcgacctgcagactgggctgggagatggagagcccgctcacgcccacccgaccgcctaccaccagtgttcccggatgcatgggctccagcgcctgccctttcgccatttcctcccaactggcattaaatcctggtgtggtagatatcagtgattaagagtctaggcagccacgtgttctattgccgccagtccgcaggaaacgcaagtgatcgttttgctgcgttaactctatgggcgcccaaatcttaggaatccattccacgccaccccgaaaacagcgcttgacccttctggactgccacgcaggaggcgatcaatgtttttctttctttatttttttaagagacaaggtctcgccctgtcacctaggctggagcacaatgaggctcactacagcctggaactcccggacgcaagtgatcctcctcagcctccggagtagctgagacctcaggcgtgcgccaccatgcctggcatcaatcaatgtctttcaaaataaaggctgttaaacgtagtataggaaagaagctttttaatggtaggttctaccagacgtgtttgtttgatttttaggtttggttaatgcattgtttcccgtacaatctcaacccgcggaaaccccgaaactctagaattcgtgccggtctctttcgcttccaggtcatccccggggcaacggccgccgctctaattcttgtcagaacctccaggccagtttcagcaacgtgcaggcagaagctggcccctcggtgggatgcgagggcgtgtggagcgcggggaggagagccccacaggcctttcctgggcacccgcggtggatgggaaggctccttcgggcgcctttcagggaagttgtttggctgagggaaggtggtccgtcacgtgaatgtttaaaagttgttaccttggagaagaaatggaggaaaggattggctttcggaggtgggctggaaactacaaaaccgagcttcctgggaatgccttttaggccgacaggaagtggagcgtcaccgaaagggaggggcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcca

SEQ ID NO: 131636 - DNA, 730 bp, Homo sapiens
  Payload ID: 5692
  Gene Symbol: EXTL2
  Gene Name: exostosin-like glycosyltransferase 2
  ENST ID: ENST00000416479
  CDS Start-End: 380-730
actttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgagaacctggaacagtggtggcacaaagtaagtgctcaggaactatctgttgaatgagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacagg

SEQ ID NO: 131637 - DNA, 902 bp, Homo sapiens
  Payload ID: 5692
  Gene Symbol: EXTL2
  Gene Name: exostosin-like glycosyltransferase 2
  ENST ID: ENST00000450240
  CDS Start-End: 104-902
ggctggccctactgcaatctactgcactcgagtgacaagtgagcctgcttctgtcaattactgaagctataaggagattttttaaaaattaaacttcaacacaatgagaacctggaacagtggtggcacaaagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaaga

SEQ ID NO: 131638 - DNA, 3146 bp, Homo sapiens
  Payload ID: 5692
  Gene Symbol: EXTL2
  Gene Name: exostosin-like glycosyltransferase 2
  ENST ID: ENST00000535414
  CDS Start-End: 655-1098
tcttgtcagaacctccaggccagtttcagcaacgtgcaggcagaagctggcccctcggtgggatgcgagggcgtgtggagcgcggggaggagagccccacaggcctttcctgggcacccgcggtggatgggaaggctccttcgggcgcctttcagggaagttgtttggctgagggaaggtggtccgtcacgtgaatgtttaaaagttgttaccttggagaagaaatggaggaaaggattggctttcggaggtgggctggaaactacaaaaccgagcttcctgggaatgccttttaggccgacaggaagtggagcgtcaccgaaagggaggggcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatccatgtgttctgtgttaa

SEQ ID NO: 131639 - DNA, 6483 bp, Homo sapiens
  Payload ID: 5693
  Gene Symbol: EXTL3
  Gene Name: exostosin-like glycosyltransferase 3
  Uniprot ID: O43909
  ENST ID: ENST00000220562
  CDS Start-End: 903-3662
acaatccccggcgcccggccccgcgcccctgacccgggtgtcaccgcggagctgcgggaggcctcggcggtcttcggacgcggtcgggaaagtggcgagcgcgcgcccgcgtccgcgcccccgctcgcgaacgccggcttcggccatttccggcgcggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 131640 - DNA, 565 bp, Homo sapiens
  Payload ID: 5693
  Gene Symbol: EXTL3
  Gene Name: exostosin-like glycosyltransferase 3
  ENST ID: ENST00000522698
  CDS Start-End: 1-227
acctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggaca

SEQ ID NO: 131641 - DNA, 1779 bp, Homo sapiens
  Payload ID: 5693
  Gene Symbol: EXTL3
  Gene Name: exostosin-like glycosyltransferase 3
  ENST ID: ENST00000523149
  CDS Start-End: 135-1742
agagggcggggccgggccgctggcgctgtcgccggctgcagtggccgccgctggagaccgcgggacctggcgctgcagcgaggagagcaagccctggaggttcactctttcaagaagtcgtgtgctgaggtgtaatgctacacaagtcagaggaaggaagggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagg

SEQ ID NO: 131642 - DNA, 601 bp, Homo sapiens
  Payload ID: 5693
  Gene Symbol: EXTL3
  Gene Name: exostosin-like glycosyltransferase 3
  ENST ID: ENST00000521473
  CDS Start-End: 1-601
gttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccat

SEQ ID NO: 131643 - DNA, 529 bp, Homo sapiens
  Payload ID: 5693
  Gene Symbol: EXTL3
  Gene Name: exostosin-like glycosyltransferase 3
  ENST ID: ENST00000517738
  CDS Start-End: 174-529
agagctccttggaaaccattcataaatttaagtcctcggatgcagttaattcatgccaggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccactt

SEQ ID NO: 131644 - DNA, 517 bp, Homo sapiens
  Payload ID: 5693
  Gene Symbol: EXTL3
  Gene Name: exostosin-like glycosyltransferase 3
  ENST ID: ENST00000521532
  CDS Start-End: 105-517
agctacatttggggagtggtgaaaaggggtcagagaaagagaagcaggagaggacatgggcaggaagtgtaaaatgcagactgacttaatatgaggtgcacagcatgggtgagaacgcaagacactttgataggagaaatgaaggtgtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgt

SEQ ID NO: 131645 - DNA, 4915 bp, Homo sapiens
  Payload ID: 5694
  Gene Symbol: XPO1
  Gene Name: exportin 1
  Uniprot ID: O14980
  ENST ID: ENST00000401558
  CDS Start-End: 729-3944
caaccggttccgagtttgaggcactaggaggagggggagaagcggctgcagcggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggggccagcgccggagccgcgtgagagagggagccgtgttttggtaggggggagtcggactgcaactggcagcagagcgtctccccggccgtgtggactctacaccccctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtgtgtgtgtgtgttgggggaagcgtccctgaaatagtaaatattattgagctctttttgcccttttcctgtccgtttttttaatttccttttttgaggtgggaaaactgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagtt

SEQ ID NO: 131646 - DNA, 3479 bp, Homo sapiens
  Payload ID: 5694
  Gene Symbol: XPO1
  Gene Name: exportin 1
  Uniprot ID: O14980
  ENST ID: ENST00000406957
  CDS Start-End: 144-3359
ggagaagcggctgcagcggccgcggcaggagcagcgggagctacagcatcagcaagagcaacagtagctacagccccggcggcggtgcctgttccagtctttgctgctgcagaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggcccttt

SEQ ID NO: 131647 - DNA, 4105 bp, Homo sapiens
  Payload ID: 5694
  Gene Symbol: XPO1
  Gene Name: exportin 1
  Uniprot ID: O14980
  ENST ID: ENST00000404992
  CDS Start-End: 408-3623
agcttgggatgggggagggaggggctgccgactccctgttcctccagcaaggaaactcgaaagctctccggttttgcagagtggcatgtgaagtaggaaagatcagtttttcaggggcctgcacatgggattccgtcttgtagttccttttcaggggtttgaatgtgataagttggttaaaccatttactgttggccttgtacagtggaggatgccctgattctccttcattccgatgtctgtgagtttgggttgggtgggaggaagtggtgtagtagaggaagcattcagtactggctcagcccggacctcctctgatcacgccgaggccatgctgcatagagaaaggggcggtgaacttaaggcgcctggtctaaatgcctcctccgagtaagggcgggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactg

SEQ ID NO: 131648 - DNA, 537 bp, Homo sapiens
  Payload ID: 5694
  Gene Symbol: XPO1
  Gene Name: exportin 1
  ENST ID: ENST00000437159
  CDS Start-End: 1-219
agaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttcc

SEQ ID NO: 131649 - DNA, 318 bp, Homo sapiens
  Payload ID: 5694
  Gene Symbol: XPO1
  Gene Name: exportin 1
  ENST ID: ENST00000436018
  CDS Start-End: 142-318
ggctttccttcgctctcttttctactcatccctgctcttcgtcccacctcctcctcctccacccctctcctcttgcctttcgaccctccccacttcccctcccccactctgcgggcaaatcgctgctgaaaagagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgct

SEQ ID NO: 131650 - DNA, 682 bp, Homo sapiens
  Payload ID: 5694
  Gene Symbol: XPO1
  Gene Name: exportin 1
  ENST ID: ENST00000420673
  CDS Start-End: 382-682
acttgcttaaaaagttttgacatcaagatactgaactgtatcacgttttaggaccataaaatcctaatagtggatgcgtttaaataataggttagcatactttataaatgttagtagaataggaaagtcttcctggtgtataaactaaacactagaaaagttgaatggaccataataatttatgtaattatcaaatagctaagtaatttcagcttttgttacttgcttttactatctcagttttctgtaattaaagtctctaaagtattcattaaaatatttgtaataacatggttgaagtaaaataacttgtaggaagtttttgataataccaaaacttgataggcagcttcaattttttttctttattttcagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaag

SEQ ID NO: 131651 - DNA, 488 bp, Homo sapiens
  Payload ID: 5694
  Gene Symbol: XPO1
  Gene Name: exportin 1
  ENST ID: ENST00000457483
  CDS Start-End: 207-488
gtcccctctcccccctccccaccttccctcgccctaatcccccaacgaggaaggaaggagcagttggttcaatctctggatggagtctcattctcttgcccaggctagagtgtggtggtgcatctcggcttactgcaaactccgtctcctgggttcaagcagttctcctgcctcagcttcccaagtagctgggattacagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattctt

SEQ ID NO: 131652 - DNA, 565 bp, Homo sapiens
  Payload ID: 5694
  Gene Symbol: XPO1
  Gene Name: exportin 1
  ENST ID: ENST00000443240
  CDS Start-End: 168-565
ggctttccttcgctctcttttctactcatccctgctcttcgtcccacctcctcctcctccacccctctcctcttgcctttcgaccctccccacttcccctcccccactctgcgggcaaatcgctgctgaaaagaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgat

SEQ ID NO: 131653 - DNA, 579 bp, Homo sapiens
  Payload ID: 5694
  Gene Symbol: XPO1
  Gene Name: exportin 1
  ENST ID: ENST00000449444
  CDS Start-End: 394-579
acaacctaaggagcagtctttcgccttgtagcgacttgtttttcacctagtgtgaagttattaagcaacggttatgattttctgggttttgtttaggaattggcattgggtgtcacttgtagagtcacattatccattaagctggataatccctagtgtatgttatccagtgagtggattttaggattgaagagcccaatgggaatgagcgttcgtggttacacctctcgcactatggcttgtttgctgtctgattgtatatcttaagtgtgggacactgctgttagtggaaagaatgttttggaagcggtttgatttgggggactaaatgtgcttggcattgaccacaaagccgccatttctgtactatgtacagttcaggaatagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaaga

SEQ ID NO: 131654 - DNA, 6776 bp, Homo sapiens
  Payload ID: 5694
  Gene Symbol: XPO1
  Gene Name: exportin 1
  ENST ID: ENST00000428210
  CDS Start-End: 677-925
ggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggggccagcgccggagccgcgtgagagagggagccgtgttttggtaggggggagtcggactgcaactggcagcagagcgtctccccggccgtgtggactctacaccccctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtgtgtgtgtgtgttgggggaagcgtccctgaaatagtaaatattattgagctctttttgcccttttcctgtccgtttttttaatttccttttttgaggtgggaaaactgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaagtaagcaagtggtggttttaaaatctgttatttcttttcttccagtcataaactttgaggaaggtatctcatttttagtattagcatttgttatctcaaattattttatattgttaatttgtttcaaaatttagtcttaagcatataattaattcttgcaaatagtcctaagaattatgaatgaagttttgtaatgggactagtatgcaaggtggcttttttggttgtctgattttgtttttttctttttagtatatgtatacaggtctaagtagcataaattctgaatgttattcagagattaaacataacattaaggaattattttgggcaagtaatcaatataatacaggccaggcacctctgacaccaagttgtgtggacagcttaaaaccctactccatggcattgggcttctaatgggacagcactcagtttttatttacaatggaaaatgttataattctggtccttttttaagtttgaacagaagggttgatcaaaatgtgttttgtctgttttaggcttgatgattcacgcttctctttaaactgccttaaagtaataaatactatggcattctgtttaatacacgaaaggtttccacttgatatacattgtgttaaaacagaagatagccatattcacatctgtttctgaaaccagactttgttaattaacagttttaaaatattaattagttttgacatcttgtaaattttaggtcaaaaatacagtccagaacttcctcaaagtgctaaccttaagtaacataacagtgtttgcctgtttgcttgcctggtaaattttgctttttatactgacagacattactaatgtttaagttgatttatcaacagtatttttaaaaactcaaatttgtcttgtgaaaaatgagatgattagaggaacagaaagaaagcaacaggaagaaaaggggtgtcttcctgtgcaactgacacagctaggctttgacggcaggcctccacaagtactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtaacagagcggttggttgagtgttcttcctgttgcatactgtggttttgaggtctgaatccaaatacttctaatctgtgtaaataaattagctataaaaagagaacccaacaacttctccatgagtgtggaaaactagaacatgaaaggagttgagtctagaaccttgattctcaagagtgtggtccttctctcagtatcaacattggttgtgatttcgttaggcaaattcattggccacctgccaatctactaaaccagagtctaggaatgagacacaggaaactcctgtaacagaagttggttaaaaaaatcacattaaaacacacttaaataattataaagccatttttgtagaattacagtgaaaaaaaattttttcttttggagacagggtcttgctctgtggctcaggttggagtgcagtggcgtggtcatagctcactacaatcttgaactcctagactaaagcaattctcttgtgtcagcctcccaagtaattggttgcaggcacacaccaccatgcctagcaaattttaaattttttagttttacttcatttatatttacatagttttttctgttgtgctttaagccccagtatttttattgttttagagattgggtgtcattttgtgttgctcaagctgctctcaaattcctggccacaacagttctttttgcctcggccctccggaatagttggaattataggcatgaatccctacacatggctggcttgtggtttttttggttttgtttgtttttaactaagcttctacactaatgatttcagtgatctaacgatttttttcttgattgatatattgttgagtataggtccgtttattaatggttagtcgaatggctaaaccagaggaagtattggttgtagagaatgatcaaggagaagttgtgagagaattcatgaaggatacagattccataaatttgtataagaatatgagggaaacattgggtaagttaataaatactgttaatctttacctttataaatctattctggggtggaaatacattttaggaaatgtacttgtagtttctaaatattttctaaatgtattgttactcatcaataaaattctgctcattatttgcatttgaaaccatgtttttctttgtagtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 131655 - DNA, 382 bp, Homo sapiens
  Payload ID: 5694
  Gene Symbol: XPO1
  Gene Name: exportin 1
  ENST ID: ENST00000422552
  CDS Start-End: 97-382
cggggttttgccatgttggccaggctggtctggaactcctgacctcaagtgattcgcccacctcggcctcccaaagtgctgggattacagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaa

SEQ ID NO: 131656 - DNA, 643 bp, Homo sapiens
  Payload ID: 5694
  Gene Symbol: XPO1
  Gene Name: exportin 1
  ENST ID: ENST00000451765
  CDS Start-End: 106-643
ggtggagagcttgggatgggggagggaggggctgccgactccctgttcctccagcaaggaaactcgaaagctctccggttttgcagagtggcatgtgaataatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttg

SEQ ID NO: 131657 - DNA, 9921 bp, Homo sapiens
  Payload ID: 5695
  Gene Symbol: XPO4
  Gene Name: exportin 4
  Uniprot ID: Q9C0E2
  ENST ID: ENST00000255305
  CDS Start-End: 73-3528
cgcggcggcgattggccggccgcggcgcccgctcccagaatgcagcgcatggcgcgtcattgaagagagaccatgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaatttgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagttacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgtgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacatttttgttttgaccatgtgtgatttgttcatgggtatttagctagactcttttatgaaatgcattgaaatggtgctagtttgtttaccattataggaagattgacactggggacattacacggtcctaaaataattttaaatttaaaaaaatgaagacatctgtacagataaaaatcaagatttgcatcaccttctgggagaacccgtggtactcacagaatatccagtattagaaatataaaaattttgtctatattttataatatttatctcagcccacagtcttagaaacagtttcacagttactagttaagtcattatctttggtgcatatttagtaaatacttttagcaagtcattctttttggcctttcagggaaagtggtgaattaccatattactgtgtgctagatagatccaccctttgcccagtgttaaatcttgtaaacatatgaagtgaaaagttaatttttaaagaaaatgcatctttaaaatgttcatttttaacctgaatttgctttgaatattctttgatttgtaatgttgttatttagcttatattgagatttattccactccaaaggtggataaagaaaagttgtttaagaaaaccaattagagtgtattttgaatttttgtttctttcattaccaagtgtggggccatacacacaggctaatcatctgtcatttgagacccacagatgatttcaaaggtcccaaataaatacacatctataactgttttttaaaagacatctttaatggtgctctccaaaaatacaattcggttgcttatgagtgatgcctttgacaggctgattagattataaaacagttttgtttttttaaacatagggtctcagattgagtcttgtgcattctatgtaatctcaaatggcagttcagtttgactttcttttaaaactaagtggaaatggtatatttggtgaaactaatgaaagaatcttttgctgggaaattccatacagcacccccagcagcatcctgtctcagtctggcgtataattcaacctcctactgagtgtccctgtaaattatttttaatatatagcatgagagtgaactgaggtaagtcattgatgtttcccagagatgatgaatgaacaaaagcaaataggatctgctaaacatttttattcccacagtagtgagcagttttgttcttgttttgataatgttcatttctgcctaatcttaggcttcaaatacacctttaagaaagcccaagatgtattgagtagtagaacttcttatttgtacacctgtttataactgcactgccctggatgttatggttatttctaaggactgacctggtaaagctacttgaactggtagactgcagggtagaggcagacctagattcaatgtctaactaagctgcttagggcttacattaatttccacaggtctgttatccatatcatgagtttataagtgttcctcccaaagaaaaaatttaaaagtgatggatgaaatataatagtagatgctcaataaattccattgtatttaaagatta

SEQ ID NO: 131658 - DNA, 9884 bp, Homo sapiens
  Payload ID: 5695
  Gene Symbol: XPO4
  Gene Name: exportin 4
  ENST ID: ENST00000400602
  CDS Start-End: 37-3492
agaatgcagcgcatggcgcgtcattgaagagagaccatgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaaactgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagttacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgtgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacatttttgttttgaccatgtgtgatttgttcatgggtatttagctagactcttttatgaaatgcattgaaatggtgctagtttgtttaccattataggaagattgacactggggacattacacggtcctaaaataattttaaatttaaaaaaatgaagacatctgtacagataaaaatcaagatttgcatcaccttctgggagaacccgtggtactcacagaatatccagtattagaaatataaaaattttgtctatattttataatatttatctcagcccacagtcttagaaacagtttcacagttactagttaagtcattatctttggtgcatatttagtaaatacttttagcaagtcattctttttggcctttcagggaaagtggtgaattaccatattactgtgtgctagatagatccaccctttgcccagtgttaaatcttgtaaacatatgaagtgaaaagttaatttttaaagaaaatgcatctttaaaatgttcatttttaacctgaatttgctttgaatattctttgatttgtaatgttgttatttagcttatattgagatttattccactccaaaggtggataaagaaaagttgtttaagaaaaccaattagagtgtattttgaatttttgtttctttcattaccaagtgtggggccatacacacaggctaatcatctgtcatttgagacccacagatgatttcaaaggtcccaaataaatacacatctataactgttttttaaaagacatctttaatggtgctctccaaaaatacaattcggttgcttatgagtgatgcctttgacaggctgattagattataaaacagttttgtttttttaaacatagggtctcagattgagtcttgtgcattctatgtaatctcaaatggcagttcagtttgactttcttttaaaactaagtggaaatggtatatttggtgaaactaatgaaagaatcttttgctgggaaattccatacagcacccccagcagcatcctgtctcagtctggcgtataattcaacctcctactgagtgtccctgtaaattatttttaatatatagcatgagagtgaactgaggtaagtcattgatgtttcccagagatgatgaatgaacaaaagcaaataggatctgctaaacatttttattcccacagtagtgagcagttttgttcttgttttgataatgttcatttctgcctaatcttaggcttcaaatacacctttaagaaagcccaagatgtattgagtagtagaacttcttatttgtacacctgtttataactgcactgccctggatgttatggttatttctaaggactgacctggtaaagctacttgaactggtagactgcagggtagaggcagacctagattcaatgtctaactaagctgcttagggcttacattaatttccacaggtctgttatccatatcatgagtttataagtgttcctcccaaagaaaaaatttaaaagtgatggatgaaatataatagtagatgctcaataaattccattgtatttaaagatt

SEQ ID NO: 131659 - DNA, 5364 bp, Homo sapiens
  Payload ID: 5696
  Gene Symbol: XPO5
  Gene Name: exportin 5
  Uniprot ID: Q9HAV4
  ENST ID: ENST00000265351
  CDS Start-End: 212-3826
acttccgcgggcgcgtgcgcagtggcgggccgggcgcgtgcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgtgtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggaagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacagaaaggga

SEQ ID NO: 131660 - DNA, 568 bp, Homo sapiens
  Payload ID: 5696
  Gene Symbol: XPO5
  Gene Name: exportin 5
  ENST ID: ENST00000398799
  CDS Start-End: 122-352
agcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtaaggagctcttggacattaccactgaagtctgagagaacagatctttatatcttatataacctatagagatgctgtttaggtttcggtggaacggcatgtctcgattggagaaggtgtatctgaagaacagtgtcatggagctgattgcaaatggaacattgaacattttggaagaggagaaccatattaaagatgctctgtctcgaattgtagtgga

SEQ ID NO: 131661 - DNA, 868 bp, Homo sapiens
  Payload ID: 5696
  Gene Symbol: XPO5
  Gene Name: exportin 5
  ENST ID: ENST00000398835
  CDS Start-End: 1-74
atgtgggtacagatcagaagagctgtgacccaggcctggaggatccgtgtggcttaaaccgtgcacgatcttgaattcttgagttagttcccacagcagagcagatggtcttttctatgaagtcattattttggctttaaggatctctaaatagctctgaagactgaaggtgtaatgaggaagtaggtcagaacttggtcagcaggatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgtgtctttgtaaagcctctggtgctcttctgtcccccagagcactatgaagccctggtatcccccatcctcggacctcttttcacctacctccatatgaggctttctcagaaatggcaagttatcaaccaaaggagcctgctgtg

SEQ ID NO: 131662 - DNA, 758 bp, Homo sapiens
  Payload ID: 5696
  Gene Symbol: XPO5
  Gene Name: exportin 5
  ENST ID: ENST00000455285
  CDS Start-End: 1-758
agcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacggatggagcttaacattctactctctgataacagatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctg

SEQ ID NO: 131663 - DNA, 800 bp, Homo sapiens
  Payload ID: 5696
  Gene Symbol: XPO5
  Gene Name: exportin 5
  ENST ID: ENST00000496341
  CDS Start-End: 1-324
ggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgt

SEQ ID NO: 131664 - DNA, 601 bp, Homo sapiens
  Payload ID: 5696
  Gene Symbol: XPO5
  Gene Name: exportin 5
  ENST ID: ENST00000486936
  CDS Start-End: 1-182
ggctttctcagaaatggcaagttatcaaccaaaggagcctgctgtgtggagaagatgaggctgcagatgaaaacccagagtctcaagagatgctggaggagcaactgcggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctg

SEQ ID NO: 131665 - DNA, 4422 bp, Homo sapiens
  Payload ID: 5697
  Gene Symbol: XPO6
  Gene Name: exportin 6
  Uniprot ID: Q96QU8
  ENST ID: ENST00000304658
  CDS Start-End: 502-3879
ggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcc

SEQ ID NO: 131666 - DNA, 703 bp, Homo sapiens
  Payload ID: 5697
  Gene Symbol: XPO6
  Gene Name: exportin 6
  ENST ID: ENST00000569315
  CDS Start-End: 1-462
atccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggtgaggagagaaagaggccgggctaagaggagggcagagtgggcacgcaagcctggcacctgtgcagcaaggagggggcacattgaggcctctgggcgtggtctgtgcccaccctgcagcttggcggcagctcacgagatgcctgctgacctggtgctgtagcctgattgaggggcacagccttttccccagtcttggtgtctgtagcacgtatgttcttagtctcagccatggaggtcccgagttcctggctctgcagcccctccatttgtcttggcatctttgttcatacccaggaccctgccgttctccctcctgggtgatgagccccggtggggccagcattggagtgtgcccaggcttgcattcaggctgagatggttggtgcttgggagctgcactt

SEQ ID NO: 131667 - DNA, 835 bp, Homo sapiens
  Payload ID: 5697
  Gene Symbol: XPO6
  Gene Name: exportin 6
  ENST ID: ENST00000564905
  CDS Start-End: 1-484
ggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgct

SEQ ID NO: 131668 - DNA, 558 bp, Homo sapiens
  Payload ID: 5697
  Gene Symbol: XPO6
  Gene Name: exportin 6
  ENST ID: ENST00000570033
  CDS Start-End: 131-558
gctcttgctgttgaatgtgacctagaaggaactgaggaacagtggaactgaagatgcagcttattgattttttttcaaattcctttgttaggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagct

SEQ ID NO: 131669 - DNA, 715 bp, Homo sapiens
  Payload ID: 5697
  Gene Symbol: XPO6
  Gene Name: exportin 6
  ENST ID: ENST00000566073
  CDS Start-End: 664-715
ctagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatgtgttctcaagcttcatccgtgtggtggcgtgtgtcagagcttccttccttttgaaagctgaattccattgcatctgaagaagcctctctcagggcattggaaagtctgatgacagaattttttcacgattgtacaaccaatgaaagaaaacgtgagatag

SEQ ID NO: 131670 - DNA, 942 bp, Homo sapiens
  Payload ID: 5697
  Gene Symbol: XPO6
  Gene Name: exportin 6
  ENST ID: ENST00000568065
  CDS Start-End: 1-399
tcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcggaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcc

SEQ ID NO: 131671 - DNA, 4255 bp, Homo sapiens
  Payload ID: 5697
  Gene Symbol: XPO6
  Gene Name: exportin 6
  Uniprot ID: Q96QU8
  ENST ID: ENST00000565698
  CDS Start-End: 361-3696
gaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggtagctcatgtaagtggagtcatgaagtatttggcctgttgtgactgccttatttcacatggcacagtgttctcaagcttcatccgtgtggtggcgtgtgtcagagcttccttccttttgaaagctgaattccattgcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctag

SEQ ID NO: 131672 - DNA, 262 bp, Homo sapiens
  Payload ID: 5697
  Gene Symbol: XPO6
  Gene Name: exportin 6
  ENST ID: ENST00000569951
  CDS Start-End: 198-262
gggtgggggacttcccgagtctgccgggaccatgacctgaactgtgcgagcgggacgtgtccgaagcccaagaaccagctcatctgagccgccccctccccggccagcatgaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctca

SEQ ID NO: 131673 - DNA, 403 bp, Homo sapiens
  Payload ID: 5697
  Gene Symbol: XPO6
  Gene Name: exportin 6
  ENST ID: ENST00000573275
  CDS Start-End: 1-403
tgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccag

SEQ ID NO: 131674 - DNA, 248 bp, Homo sapiens
  Payload ID: 5697
  Gene Symbol: XPO6
  Gene Name: exportin 6
  ENST ID: ENST00000566175
  CDS Start-End: 1-60
aatgcccacacagtgaagagcaggctagaagagctcgatgagaggtggttaatggaatgaagggttgcctgtcctgtagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacg

SEQ ID NO: 131675 - DNA, 765 bp, Homo sapiens
  Payload ID: 5697
  Gene Symbol: XPO6
  Gene Name: exportin 6
  ENST ID: ENST00000574435
  CDS Start-End: 1-765
gtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttgga

SEQ ID NO: 131676 - DNA, 4861 bp, Homo sapiens
  Payload ID: 5698
  Gene Symbol: XPO7
  Gene Name: exportin 7
  Uniprot ID: Q9UIA9
  ENST ID: ENST00000252512
  CDS Start-End: 101-3364
gcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactga

SEQ ID NO: 131677 - DNA, 4519 bp, Homo sapiens
  Payload ID: 5698
  Gene Symbol: XPO7
  Gene Name: exportin 7
  ENST ID: ENST00000433566
  CDS Start-End: 56-3322
ggaaccaaagtaagagtttaaagtgcaacagaagagagtctgctgaactttagacatgagggatccagggaggaagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataa

SEQ ID NO: 131678 - DNA, 569 bp, Homo sapiens
  Payload ID: 5698
  Gene Symbol: XPO7
  Gene Name: exportin 7
  ENST ID: ENST00000521303
  CDS Start-End: 1-569
atgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagtaagtgctacagccttcctcattgaagcagacaccacccatcctttaaccaagcacagaaaa

SEQ ID NO: 131679 - DNA, 883 bp, Homo sapiens
  Payload ID: 5698
  Gene Symbol: XPO7
  Gene Name: exportin 7
  ENST ID: ENST00000517551
  CDS Start-End: 172-883
attgctactaatacctgttgggataataaagggacccccttgagttcccctgggtttgctcctctttcatcccatcttcccatatatgcacagctttgaattcttggtattggggttacaccctgggatgtttcctttacaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttg

SEQ ID NO: 131680 - DNA, 6414 bp, Homo sapiens
  Payload ID: 5699
  Gene Symbol: XPOT
  Gene Name: exportin, tRNA
  Uniprot ID: O43592
  ENST ID: ENST00000332707
  CDS Start-End: 530-3418
gagttgtaggcctccggcgtcagcccgcgggctgccgcccgcactctccaagagactgctggcgccggcgcccgcccgcgcggcaccgacgcggggagcgcgcttcgcgctgactcagcggcggcggcggctgcggcggcggcggcggcgttagccggccctcgcgctctttcccttcctggggcgccgaccccgcccgcttgcttgcttgcttgcttgcctgcctgcctgcctgcccggcgccacgcaagagaaggtgccaggggacgcagagcgactagaggcgcgcggtcccggccagcaccgtctctggcgttgtagctgcggccgtggcggaggactacggcgacaaggacgagggccgctctcccagctctctgcgtgccgcgccgctccgctccgctggctgaccatctggagtgcaggctgggaggcgggatggagtgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatcttccaagtcttttctggaattattataaatactttagttttattttctcatcttaatctctccataatttcccatttaaaggtttacaaatatgagtgtgtggatgctttaattcatttaacctcactcctcaaaggtaacatgcaacttagttctgttatatgagagtctttttctttaatgtactggaaaaagcctatgtgaatctgttgatagaatttaaaattccaggccgggcgtggtggctcacgactgtaatcccagaactttgggaggccaaggcaggtggatcacttgaggtcaggagttcgagactagcctggccaacatggtgaaaccccatctctactaaaaatacaacagccaggtgtgatggtgcacgctcgtaatcccggctactcaggaggctgaggcaggagaatcgcttgaacccggaaggcagaggttgcagtgagctgagattgtgccactgcacgccagcctgggcaagagagtaagactctctctcaaaaaaaaaaaaaaagaatttaaaatcccaatttattttctaactcttttattggatgtatttagaacacagtatacctatagtatacctatgtgtttattatgtttgtaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttcttttttttttttgaatagagatcagtctatcacccaggctggagtgcagtggtgacatcatagctcactgtaacttctcccatactctaccaatcctcctgcctcagcatccagactagctgtgattacaggtgtgcaccaccacacccagctacatttttttttggtagagacagggtctcactatgttacccagtctggtctcaaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttacaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaagaatt

SEQ ID NO: 131681 - DNA, 984 bp, Homo sapiens
  Payload ID: 5699
  Gene Symbol: XPOT
  Gene Name: exportin, tRNA
  ENST ID: ENST00000400935
  CDS Start-End: 380-984
cctgggacacggagcttgcagtgagctgatacggtgccactgcactccagcctgggcaacagagtgagactccgtctcaaaaaaaaaaatcagatttttaggaattacacattagtggagtagttagcagagcccatttttctgagaattaggctctaacttttagttgtaatttagataagttccaaaataagtttttaaacatttaagcttctttgcatgattttatccatttacgttattcaggataagcatctatttgtttatcaagtaatgttttctttcaactttgttttttgtggcagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgac

SEQ ID NO: 131682 - DNA, 548 bp, Homo sapiens
  Payload ID: 5699
  Gene Symbol: XPOT
  Gene Name: exportin, tRNA
  ENST ID: ENST00000540203
  CDS Start-End: 367-548
acccgaattgccacgaggcttcctttaggggagggatcgggggagggatgggagcaaggctagcagaggagggtcggcatcgcctgtggttccgaagcccgttagtcatcgttgtagcgttatcaactgtggagacctcaaacttgattcttcccccacccctggacaaaaaggaaaagtgttatttctgtgcagtaattggccagcacggacgctccatttcttctcaaaccttcctcaccatcctgcaggactagagaagcatgaggtttccctgtaaccagaaaaacgaatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactgga

SEQ ID NO: 131683 - DNA, 787 bp, Homo sapiens
  Payload ID: 5699
  Gene Symbol: XPOT
  Gene Name: exportin, tRNA
  ENST ID: ENST00000538086
  CDS Start-End: 1-192
gtttttagttctacactgcagaattggcagactacacggtttatggaagttgaagtagcaataagattgctgtatatgttggcagaagctcttccagtatctcatggtgctcacttctcagctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtact

SEQ ID NO: 131684 - DNA, 3577 bp, Homo sapiens
  Payload ID: 5700
  Gene Symbol: ESYT1
  Gene Name: extended synaptotagmin-like protein 1
  Uniprot ID: Q9BSJ8
  ENST ID: ENST00000267113
  CDS Start-End: 54-3398
aggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctatggtgacctctgaattgtacccaccacagctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttcc

SEQ ID NO: 131685 - DNA, 4388 bp, Homo sapiens
  Payload ID: 5700
  Gene Symbol: ESYT1
  Gene Name: extended synaptotagmin-like protein 1
  Uniprot ID: Q9BSJ8
  ENST ID: ENST00000394048
  CDS Start-End: 265-3579
atcttggccttcgggcccaatcagggaggccctacctatccgaaacccggtccgttccccgcggaagaggggtggagtttcaaccttttaactccaccttggtctgtgcagcgcggaccaacccaaatcgccagaaaggaggggcgtggcttgaagtcccctcctccatcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaa

SEQ ID NO: 131686 - DNA, 540 bp, Homo sapiens
  Payload ID: 5700
  Gene Symbol: ESYT1
  Gene Name: extended synaptotagmin-like protein 1
  ENST ID: ENST00000551790
  CDS Start-End: 277-540
gggtaggcggctctttgtcgaagctagaggaccggcaggcggcagcagcaactacggcggcggcggcagaacccagcagtgatgtggaggtggagacccacaggagccccggacttcacctgagctacctcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctg

SEQ ID NO: 131687 - DNA, 5960 bp, Homo sapiens
  Payload ID: 5701
  Gene Symbol: ESYT2
  Gene Name: extended synaptotagmin-like protein 2
  Uniprot ID: A0FGR8
  ENST ID: ENST00000251527
  CDS Start-End: 67-2748
agtatccaccccgcccgctcccggtgacgtgccagccccaggcccacgccgctcccgccccgcgtgatgacgccaccgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagt

SEQ ID NO: 131688 - DNA, 3251 bp, Homo sapiens
  Payload ID: 5701
  Gene Symbol: ESYT2
  Gene Name: extended synaptotagmin-like protein 2
  ENST ID: ENST00000275418
  CDS Start-End: 1-2655
agcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaa

SEQ ID NO: 131689 - DNA, 2766 bp, Homo sapiens
  Payload ID: 5701
  Gene Symbol: ESYT2
  Gene Name: extended synaptotagmin-like protein 2
  ENST ID: ENST00000613624
  CDS Start-End: 1-2766
atgaccgcaaacagggacgccgccctctcatcccaccgccaccccggctgcgctcagcggccgcgcacccccacgtttgccagcagctcccagaggcggtcagcctttgggtttgacgacggcaacttcccgggcctcggcgagcgcagccacgcacccggaagccgcctcggggcgcgacgccgagccaaaaccgcccgcgggctccgaggccacaggcaaaggggcgctggcgcggggctgagccgcccgggatcagcgcgagcacccagcccgcctcggccgggagcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatag

SEQ ID NO: 131690 - DNA, 1356 bp, Homo sapiens
  Payload ID: 5702
  Gene Symbol: ESYT3
  Gene Name: extended synaptotagmin-like protein 3
  ENST ID: ENST00000289135
  CDS Start-End: 175-1107
ggcgctgctctccgtcgcagagaaccctgagctcggcgcgccgagagtcccagcagggcaagggggcgcggcgtcctggtcctcgagcttgggagacagatgcgcatgggcgtgggggcatgcggacctaagctcgggtgaagctctcgggaagggcaagactgcggcgacgagatgcgagcagaggagccctgcgcccccggggcccccagcgccctgggagcccagcgcacgccgggccccgagctgcgcctgtccagccagctgctgcccgagctctgtaccttcgtggtgcgcgtgctgttctacctggggcctgtctacctagctggctacctggggctcagcataacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctggatccacttcccggacgtggagcgggtcgagtgggccaacaagatcatctctcagacctggccctacctaagcatgatcatggaaagcaagttccgggagaaacttgagcccaagatccgagagaagagcatccacctgaggacctttacctttaccaagctctactttggacagaagtgtcccagggtcaacggtgtcaaggcacacactaatacgtgcaaccgaagacgtgtgactgtggacctgcagatctgctacatcggggactgtgagatcagtgtggagctgcagaagattcaggctggtgtgaacgggatccagttgcagggcaccctgcgggtcatcctggagcccctcctagtggacaagccctttgtgggagccgtgactgtgttcttccttcagaagccgcacctacagatcaactggactggcctgaccaacctgctggatgcgccgggaatcaatgatgtgtcagacagcttactggaggacctcattgccacccacctggtgctgcccaaccgtgtgactgtgcctgtgaagaaggggctggatctgaccaacctgcgcttccctctgccctgtgtgagtacccagtactagccacagaccagcctgctgggaggcagcgcaaatatcctctcagccttcacatgtggtgcattggctttatttcacactaatgcttgacagtcccagaaaaatggtacaaacaccatcgcccacgtcataattactaaagacattttgtccttggggtgtatcccacttgggaggtagtgtcaaatttactgcattctaaacttacttggaatatttcctctgtttgtgacaactgaccatgaatattta

SEQ ID NO: 131691 - DNA, 4407 bp, Homo sapiens
  Payload ID: 5702
  Gene Symbol: ESYT3
  Gene Name: extended synaptotagmin-like protein 3
  Uniprot ID: A0FGR9
  ENST ID: ENST00000389567
  CDS Start-End: 187-2847
ggtgcatttccaggcgctgctctccgtcgcagagaaccctgagctcggcgcgccgagagtcccagcagggcaagggggcgcggcgtcctggtcctcgagcttgggagacagatgcgcatgggcgtgggggcatgcggacctaagctcgggtgaagctctcgggaagggcaagactgcggcgacgagatgcgagcagaggagccctgcgcccccggggcccccagcgccctgggagcccagcgcacgccgggccccgagctgcgcctgtccagccagctgctgcccgagctctgtaccttcgtggtgcgcgtgctgttctacctggggcctgtctacctagctggctacctggggctcagcataacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctggatccacttcccggacgtggagcgggtcgagtgggccaacaagatcatctctcagacctggccctacctaagcatgatcatggaaagcaagttccgggagaaacttgagcccaagatccgagagaagagcatccacctgaggacctttacctttaccaagctctactttggacagaagtgtcccagggtcaacggtgtcaaggcacacactaatacgtgcaaccgaagacgtgtgactgtggacctgcagatctgctacatcggggactgtgagatcagtgtggagctgcagaagattcaggctggtgtgaacgggatccagttgcagggcaccctgcgggtcatcctggagcccctcctagtggacaagccctttgtgggagccgtgactgtgttcttccttcagaagccgcacctacagatcaactggactggcctgaccaacctgctggatgcgccgggaatcaatgatgtgtcagacagcttactggaggacctcattgccacccacctggtgctgcccaaccgtgtgactgtgcctgtgaagaaggggctggatctgaccaacctgcgcttccctctgccctgtggggtgatcagagtgcacttgctggaggcagagcagctggcccagaaggacaactttctggggctccgaggcaagtcagatccctacgccaaggtgagcatcggcctacagcatttccggagtaggaccatctacaggaacctgaaccccacctggaacgaagtgtttgagttcatggtgtacgaagtccctggacaggacctggaggtagacctgtatgatgaggataccgacagggatgacttcctgggcagcctgcagatctgccttggagatgtcatgaccaacagagtggtggatgagtggtttgtcctgaatgacacaaccagcgggcggctgcacctgcggctggagtggctttcattgcttactgaccaagaagttctgactgaggaccatggtggcctttccactgccattctcgtggtcttcttggagagtgcctgcaacttgccgagaaacccttttgactacctgaatggtgaatatcgagccaaaaaactctccaggtttgccagaaacaaggtcagcaaagacccttcttcctatgtcaaactatctgtaggcaagaagacacatacaagtaagacctgtccccacaacaaggaccctgtgtggagccaggtgttctccttctttgtgcacaatgtggccactgagcggctccatctgaaggtgcttgatgatgaccaggagtgtgctctgggaatgctggaggtccccctgtgccagatcctcccctatgctgacctcactcttgagcagcgctttcagctggaccactcaggcctggacagcctcatctccatgaggctggtgcttcggttcctgcaagtggaggaacgagagctggggagcccatacacaggacctgaagccctaaagaaaggccctctgctcatcaagaaagtggctaccaaccagggtcccaaagcccaacctcaggaagaaggccctacagatttgccatgtcccccagaccctgcttctgatactaaggacgtatccaggagtaccacaaccaccaccagtgctaccaccgttgccactgagcccacatcccaagagacaggcccagagcctaaaggcaaggacagtgccaaaaggttctgtgagcccatcggggagaagaagagtccagccaccatcttcctgactgtcccaggtccccactctccagggcccatcaagtcacccagacccatgaaatgccctgcctccccattcgcatggccgcccaagaggctggctcccagcatgtcctcgctcaactccttggcctcttcttgctttgacctggcagatatcagcctcaacattgaaggtggggacctcaggcgacggcagctgggtgagattcagctcacagtgcgctatgtgtgtctgcggcgctgcctcagcgtgctaatcaatggctgcagaaacctaacaccatgtaccagcagtggagctgatccctacgtccgtgtctacttgttgccagaaaggaagtgggcatgtcgtaagaagacttcagtgaagcggaagaccttggaacccctgtttgatgagacatttgaattttttgttcccatggaagaagtaaagaagaggtcactagatgttgcagtgaaaaatagtaggccacttggctcacacagaagaaaggagttaggaaaagtactgattgacttatcaaaagaagatctgattaagggcttttcacaatggtatgagctgactccaaatggacagcccagaagctgatgatgagaattcttatcactcacctttatattaaaatgtatatatatgtatatattttttcctttggatcacttacatccaatatatgtatattttgtcatttaaatcagaacaaccacttgaaattatatacatacaattcttgtgtggaatttaactccatgactgaatagcataaggaagaggttatttaaaagcaagaactactttttttggttggatttttttgttcaagtccagaaagaaatgttatatttgtgcctactaaattatccaaacctcagtgtttatatacttaaacaagtgccactttttagtaggtaattatataccatctgatttaggacttacctgaatgtatgtaccagaaagtgtcctgcctctggcataggggctgggggaggtctgtttctggagccactaccagcattcctgggcagtgactggccaaagggaagtcacttttttatggaaatagaaagtgacccaactcaaaactgccaagagctaacactgccaaagcccttctggctgccacctgtggtacttgtatgcctggatatttgttcttttatttgacctggagctaaaaatgtatttccctactggcaaaaatgttatactgatatacttaaataccttgagttaaatactcttgtgtagtctaagggccaaactccagcgtgtagcattatttccataggaaaatgcaaaccaagttccaagcccaggtctatgtctgactctcatagcaaagcactggagactgctgaagagtgtcaccatcagagaaaaggaagctttcagataagtttaggctattcaacttttctaaagagatggttggttcacctaaataacatgttaaaagcaaagtattaaattatatgcttaaacaagcgcctcttttacatttcagactttacaagaccaaatatacttctcatcccctccaacattcctggacctcctcttctctcttaccaacaccaacactacctgccgtcagttttctgtctctgcctctgccttcactgccacttttctgaagcagggcaacattcgagaacaaagttttgtcatgttactcttattccagtttcctgccatctgattcacatgcagatgttctattccagagtagtccaaatactatgctctgctgactcaagtcatgtctcaaacctatttcctctattaagtaagtcagtcaatccatagtgaaatggactcttcctaccgcctgtagcatttactgttgatactgagtattttccattttaatagttcccagcctttataacactaagttttaagaaatgttgattaggcatctgctaaggttacatgctaagcagctacttatattgtatttggtatttaattttgtttattctccagttgaacagtagggaacaattcaagctacttgaattgtttttcaccctcaccatccaagaccgtgttaagtacatagaagatgcatggtgaaattcgtttctgctgaggtttctattttaaatggcaaattctcataataaaatggagcattgatgccta

SEQ ID NO: 131692 - DNA, 2398 bp, Homo sapiens
  Payload ID: 5702
  Gene Symbol: ESYT3
  Gene Name: extended synaptotagmin-like protein 3
  Uniprot ID: A0FGR9
  ENST ID: ENST00000490835
  CDS Start-End: 184-1689
gcatttccaggcgctgctctccgtcgcagagaaccctgagctcggcgcgccgagagtcccagcagggcaagggggcgcggcgtcctggtcctcgagcttgggagacagatgcgcatgggcgtgggggcatgcggacctaagctcgggtgaagctctcgggaagggcaagactgcggcgacgagatgcgagcagaggagccctgcgcccccggggcccccagcgccctgggagcccagcgcacgccgggccccgagctgcgcctgtccagccagctgctgcccgagctctgtaccttcgtggtgcgcgtgctgttctacctggggcctgtctacctagctggctacctggggctcagcataacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctggatccacttcccggacgtggagcgggtcgagtgggccaacaagatcatctctcagacctggccctacctaagcatgatcatggaaagcaagttccgggagaaacttgagcccaagatccgagagaagagcatccacctgaggacctttacctttaccaagctctactttggacagaagtgtcccagggtcaacggtgtcaaggcacacactaatacgtgcaaccgaagacgtgtgactgtggacctgcagatctgctacatcggggactgtgagatcagtgtggagctgcagaagattcaggctggtgtgaacgggatccagttgcagggcaccctgcgggtcatcctggagcccctcctagtggacaagccctttgtgggagccgtgactgtgttcttccttcagaagccgcacctacagatcaactggactggcctgaccaacctgctggatgcgccgggaatcaatgatgtgtcagacagcttactggaggacctcattgccacccacctggtgctgcccaaccgtgtgactgtgcctgtgaagaaggggctggatctgaccaacctgcgcttccctctgccctgtggggtgatcagagtgcacttgctggaggcagagcagctggcccagaaggacaactttctggggctccgaggcaagtcagatccctacgccaaggtgagcatcggcctacagcatttccggagtaggaccatctacaggaacctgaaccccacctggaacgaagtgtttgagttcatggtgtacgaagtccctggacaggacctggaggtagacctgtatgatgaggataccgacagggatgacttcctgggcagcctgcagatctgccttggagatgtcatgaccaacagagtggtggatgagtggtttgtcctgaatgacacaaccagcgggcggctgcacctgcggctggagtggctttcattgcttactgaccaagaagttctgactgaggaccatggtggcctttccactgccattctcgtggtcttcttggagagtgcctgcaacttgccgagaaacccttttgactacctgaatggtgaatatcgagccaaaaaactctccaggtttgccagagtgaaacaaggtcagcaaagacccttcttcctatgtcaaactatctgtaggcaagaagacacatacaagtaagacctgtccccacaacaaggaccctgtgtggagccaggtgttctccttctttgtgcacaatgtggccactgagcggctccatctgaaggtgcttgatgatgaccaggagtgtgctctgggaatgctggaggtccccctgtgccagatcctcccctatgctgacctcactcttgagcagcgctttcagctggaccactcaggcctggacagcctcatctccatgaggctggtgcttcggttcctgcaagtggaggaacgagagctggggagcccatacacaggacctgaagccctaaagaaaggccctctgctcatcaagaaagtggctaccaaccagggtcccaaagcccaacctcaggaagaaggccctacagatttgccatgtcccccagaccctgcttctgatactaaggacgtatccaggagtaccacaaccaccaccagtgctaccaccgttgccactgagcccacatcccaagagacaggcccagagcctaaaggcaaggacagtgccaaaaggttctgtgagcccatcggggagaagaagagtccagccaccatcttcctgactgtcccaggtccccactctccagggcccatcaagtcacccagacccatgaaatgccctgcctccccattcgcatggccgcccaagaggctggctcccagcatgtcctcgctcaactccttggcctcttcttgctttgac

SEQ ID NO: 131693 - DNA, 6623 bp, Homo sapiens
  Payload ID: 5703
  Gene Symbol: ESPL1
  Gene Name: extra spindle pole bodies like 1, separase
  Uniprot ID: Q14674
  ENST ID: ENST00000257934
  CDS Start-End: 92-6454
ggttacattttggatcctcgcggagtactggtcaggcggttaagtcctgtacctaggaaagagggcgagctctggggcgctctccggtgtcatgaggagcttcaaaagagtcaactttgggactctgctaagcagccagaaggaggctgaagagttgctgcccgccttgaaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctg

SEQ ID NO: 131694 - DNA, 6665 bp, Homo sapiens
  Payload ID: 5703
  Gene Symbol: ESPL1
  Gene Name: extra spindle pole bodies like 1, separase
  ENST ID: ENST00000552671
  CDS Start-End: 58-207
ggcggttaagtcctgtacctaggaaagagggcgagctctggggcgctctccggtgtcatgaggagcttcaaaagagtcaactttgggactctgctaagcagccagaaggaggctgaagagttgctgcccgccttgaaggtgggggtgctgcctggctcgggatacacctggctttccaaactgagctgttttgtgtttgccttttgaagagatggataagagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaa

SEQ ID NO: 131695 - DNA, 6447 bp, Homo sapiens
  Payload ID: 5703
  Gene Symbol: ESPL1
  Gene Name: extra spindle pole bodies like 1, separase
  Uniprot ID: Q14674
  ENST ID: ENST00000552462
  CDS Start-End: 85-6447
cggttaagtcctgtacctaggaaagagggcgagctctggggcggtaaggccggaagggactcgtgagcgtggctctccggtgtcatgaggagcttcaaaagagtcaactttgggactctgctaagcagccagaaggaggctgaagagttgctgcccgccttgaaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaa

SEQ ID NO: 131696 - DNA, 714 bp, Homo sapiens
  Payload ID: 5703
  Gene Symbol: ESPL1
  Gene Name: extra spindle pole bodies like 1, separase
  ENST ID: ENST00000553219
  CDS Start-End: 92-714
ggttacattttggatcctcgcggagtactggtcaggcggttaagtcctgtacctaggaaagagggcgagctctggggcgctctccggtgtcatgaggagcttcaaaagagtcaactttgggactctgctaagcagccagaaggaggctgaagagttgctgcccgccttgaaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccag

SEQ ID NO: 131697 - DNA, 3845 bp, Homo sapiens
  Payload ID: 5704
  Gene Symbol: ELFN1
  Gene Name: extracellular leucine-rich repeat and fibronectin type III domain containing 1
  Uniprot ID: P0C7U0
  ENST ID: ENST00000424383
  CDS Start-End: 488-2974
tacgttggtctcccaaagtgctgggattacaggtgcagctgccttggcgaccatttgtcctacagtttgtccggacccaggctgtccttctgtgtgctggaatgaggcgaacatgtctttgagcccagcagggaggaatcctccagcctattcctcgctggtgcatcaggtcgttggcgggccctgacacacaacaggaacgtcggagcaggaggagtcagtggagccatcaggacacccaggcccatggggcaggaggcctcggtcaccacaggactggggcggaagacgagaggcggccggccgtgagggaggcgccctccctccccgcgcttacgtcgcgcggccatgcggtttgggacaggacacccctgagagtgcaggcacctccccctcccgcccctccatccctctgggggctggcgcctggccccccacctggtccccctgggcaggctgaattggggctccctgcagggcggtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtgcagtacgcctcgctcagccgctttggcaacctcacgtacctcaacctcaccaagaacgagatcggctacatcgaggacggcgccttctcgggccagttcaacctgcaggtgctgcagctgggctacaaccggctgcgcaacctcacggagggcatgctgcgcggcctgggcaagctggagtacctgtacctgcaggccaacctcatcgaggtggtcatggccagcagcttctgggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcctgggccagggccgccgcggccaccgcagcatcctcagcaaactgcagtcagtctgcaccgaggactcgtacgcggctgaggtggtcgggcccccacgtccagcatccgggcgctcacagccgggccgctccccgccgcccccgcctccgccggagcccagtgacatgccctgtgccgatgatgagtgcttctccggggacggcaccacgccactggtggccctgcccacgctggccacgcaggccgaggcccgccccctcatcaaggtcaagcagctcactcagaactcggccaccatcaccgtccagctgcccagcccgttccaccggatgtacaccctggagcatttcaacaacagcaaggcctccaccgtgtccaggctgaccaaggcccaggaggagatccgtctgaccaacctgttcacgctcaccaactacacctactgcgtggtgtccaccagcgccgggctgcgccacaaccacacctgcctcaccatctgcttgccccggctgcccagcccgcctggtccggtgcccagcccctccacggccacccactacatcatgaccatcctgggctgcctcttcggcatggtgctggtgctgggcgccgtctactactgcctgcgcaggcggcggcgccaggaggagaagcacaagaaggccgcctcggcagccgcagctggcagcctcaagaagaccatcatcgagctcaagtacgggccagagctggaggcgcccggcctggccccgctgtcccagggcccgctgctgggccccgaggccgtgacgcgcatcccttacctgcctgcggccggcgaggtggagcagtacaagctggtggagagcgcggacacccccaaggccagcaagggcagctacatggaggttcgaaccggggaccctccggaacgcagggactgtgagctgggccggccgggccccgacagccagagttcggtggccgagatctccaccatcgccaaggaggtggacaaggtcaaccagatcatcaacaactgcatcgacgcgctcaagtccgagtccacctccttccagggcgtcaagtcggggcccgtgtccgtcgcggagccgccgctggtgctgctgtccgagccgctggccgccaagcacggcttcctggcgcccgggtacaaggacgccttcggccacagcctgcagcggcaccacagcgtggaggccgccgggccccctcgtgccagcacctcgtccagcggctccgtgcgcagcccccgcgccttccgagccgaggccgtcggggtgcacaaggccgcggccgccgaggccaagtacatcgagaagggctcccccgcggccgacgccatcctcactgtgacacccgcggccgccgtgctgcgggccgaggccgagaagggtcgccagtacggcgagcaccggcactcgtaccccggctcccacccggccgagccacctgcgccccccgggccaccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggccggtcctgggatgcgcttgtcgccccgggtggcacgtgtccacacacacacacacacacacacacacacacacgagggacttcggaaaactgtgtcttagggatggggggtgggggtggggatttttttttcattatctttcctcttttgagtcttctctgccttttcttttcctctctatctctttactttcttccttttttaaaaaaatataataaaagacaagttattttaaaaagacataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccagcccccatgtacactgtagtcgttctattgtacagaaaaaaatatttctatatttgcaatgtttgctgtaaaatgagaaagaaaaaaagactatgtctactaaaaaaaaaaaaaaaaagactatgtctacttaaaaaaaaatctgcaaaggaaaacaaatcaaatgcttgtt

SEQ ID NO: 131698 - DNA, 3742 bp, Homo sapiens
  Payload ID: 5704
  Gene Symbol: ELFN1
  Gene Name: extracellular leucine-rich repeat and fibronectin type III domain containing 1
  Uniprot ID: P0C7U0
  ENST ID: ENST00000561626
  CDS Start-End: 385-2871
gaggcgaacatgtctttgagcccagcagggaggaatcctccagcctattcctcgctggtgcatcaggtcgttggcgggccctgacacacaacaggaacgtcggagcaggaggagtcagtggagccatcaggacacccaggcccatggggcaggaggcctcggtcaccacaggactggggcggaagacgagaggcggccggccgtgagggaggcgccctccctccccgcgcttacgtcgcgcggccatgcggtttgggacaggacacccctgagagtgcaggcacctccccctcccgcccctccatccctctgggggctggcgcctggccccccacctggtccccctgggcaggctgaattggggctccctgcagggcggtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtgcagtacgcctcgctcagccgctttggcaacctcacgtacctcaacctcaccaagaacgagatcggctacatcgaggacggcgccttctcgggccagttcaacctgcaggtgctgcagctgggctacaaccggctgcgcaacctcacggagggcatgctgcgcggcctgggcaagctggagtacctgtacctgcaggccaacctcatcgaggtggtcatggccagcagcttctgggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcctgggccagggccgccgcggccaccgcagcatcctcagcaaactgcagtcagtctgcaccgaggactcgtacgcggctgaggtggtcgggcccccacgtccagcatccgggcgctcacagccgggccgctccccgccgcccccgcctccgccggagcccagtgacatgccctgtgccgatgatgagtgcttctccggggacggcaccacgccactggtggccctgcccacgctggccacgcaggccgaggcccgccccctcatcaaggtcaagcagctcactcagaactcggccaccatcaccgtccagctgcccagcccgttccaccggatgtacaccctggagcatttcaacaacagcaaggcctccaccgtgtccaggctgaccaaggcccaggaggagatccgtctgaccaacctgttcacgctcaccaactacacctactgcgtggtgtccaccagcgccgggctgcgccacaaccacacctgcctcaccatctgcttgccccggctgcccagcccgcctggtccggtgcccagcccctccacggccacccactacatcatgaccatcctgggctgcctcttcggcatggtgctggtgctgggcgccgtctactactgcctgcgcaggcggcggcgccaggaggagaagcacaagaaggccgcctcggcagccgcagctggcagcctcaagaagaccatcatcgagctcaagtacgggccagagctggaggcgcccggcctggccccgctgtcccagggcccgctgctgggccccgaggccgtgacgcgcatcccttacctgcctgcggccggcgaggtggagcagtacaagctggtggagagcgcggacacccccaaggccagcaagggcagctacatggaggttcgaaccggggaccctccggaacgcagggactgtgagctgggccggccgggccccgacagccagagttcggtggccgagatctccaccatcgccaaggaggtggacaaggtcaaccagatcatcaacaactgcatcgacgcgctcaagtccgagtccacctccttccagggcgtcaagtcggggcccgtgtccgtcgcggagccgccgctggtgctgctgtccgagccgctggccgccaagcacggcttcctggcgcccgggtacaaggacgccttcggccacagcctgcagcggcaccacagcgtggaggccgccgggccccctcgtgccagcacctcgtccagcggctccgtgcgcagcccccgcgccttccgagccgaggccgtcggggtgcacaaggccgcggccgccgaggccaagtacatcgagaagggctcccccgcggccgacgccatcctcactgtgacacccgcggccgccgtgctgcgggccgaggccgagaagggtcgccagtacggcgagcaccggcactcgtaccccggctcccacccggccgagccacctgcgccccccgggccaccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggccggtcctgggatgcgcttgtcgccccgggtggcacgtgtccacacacacacacacacacacacacacacacacgagggacttcggaaaactgtgtcttagggatggggggtgggggtggggatttttttttcattatctttcctcttttgagtcttctctgccttttcttttcctctctatctctttactttcttccttttttaaaaaaatataataaaagacaagttattttaaaaagacataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccagcccccatgtacactgtagtcgttctattgtacagaaaaaaatatttctatatttgcaatgtttgctgtaaaatgagaaagaaaaaaagactatgtctactaaaaaaaaaaaaaaaaagactatgtctacttaaaaaaaaatctgcaaaggaaaacaaatcaaatgcttgtt

SEQ ID NO: 131699 - DNA, 8361 bp, Homo sapiens
  Payload ID: 5705
  Gene Symbol: ELFN2
  Gene Name: extracellular leucine-rich repeat and fibronectin type III domain containing 2
  Uniprot ID: Q5R3F8
  ENST ID: ENST00000402918
  CDS Start-End: 787-3249
cacacgcgcgctcccagacacacacacagacacacgcgggccaccccacggccacgcaccccgcacccacacccgcgctcacactcacattcacactcacactcacacgcgcaggccccgcggccgccgcttcccggaggcggtgcttggcccggatcccggctggggctgggaaggagaggacttgggtgaggagctgctgccacccgggctgggccaggacctgagatctcattgctactgctgccgctgctgcctggggaacctttctgagacccaggttggggacagtgccggaggggcctcctctgctgcagacatctggaaccaggtgcagatgggtctcttccttcctgcccccatctctctcactcctggctcagtgcggcactctccagcctcctgtgggaatcatctgaagttctgagcccggaagccaaggaggaagacgaggaggaggaggaggaggaggaggaggaggagggagaggaagtcaagccctgagaacccttgcaccttcctagcaggagacaaggagcaacgctgcggtggggagcaggctgtggggcccccacccccagccctagccaggcctagtgcctgctgtagcaccctagaagatccccagcagttggcactagctgtacccaccttgcctggggcccccgtgctgggggtcgcccccaagatggtggcggccccagggaggactgtactgccagccccagcctctggccgctaggcaccccctgccttgccctggcccctcactccgaggccagcgccatgctgcgcctggggctgtgcgcggcggcgctgctgtgcgtgtgccggccgggtgccgtgcgtgccgactgctggctcattgagggcgacaagggctacgtgtggctggccatctgcagccagaaccagccgccctacgagaccatcccgcagcacatcaatagcaccgtgcacgacctgcggctcaacgagaacaagctcaaagccgtgctctactcctcgctcaaccgctttgggaacctcaccgacctcaacctcaccaagaacgagatctcctacatcgaggacggtgccttcctgggccagtcgagcctgcaggtcctgcagctgggctacaacaagctcagcaacctgacggagggcatgctgcgaggcatgagccgcctgcagttcctctttgtccagcacaacctcatcgaggtggtgacgcccaccgccttctccgagtgcccgagcctcatcagcatcgacctgtcctccaaccgcctcagccgcctggacggtgccacctttgccagcctcgccagcctgatggtgtgtgagctggccggcaaccccttcaactgtgagtgcgacctcttcggcttcctggcctggctggtggtcttcaacaacgtcaccaagaactacgaccgcctgcagtgtgagtcgccgcgggagtttgccggctacccgctgctggtgccccggccctaccacagcctcaacgccatcaccgtactccaggccaagtgtcggaatggctcgctgcccgcccggcccgtgagccaccccacgccctactccaccgacgcccagagggagccagacgagaactcgggcttcaaccccgacgagatcctttcggtggagccgccggcctcgtccaccacggatgcgtcggcagggccagccatcaagctgcaccacgtcacgttcacctcggccaccctggtggtcatcatcccacacccctacagcaagatgtacatcctcgtgcagtacaacaacagctacttctccgacgtcatgaccctcaagaacaagaaggagatcgtgacgctggacaaactgcgggcgcacactgagtacaccttctgcgtgacctcgctgcgcaacagccgccgcttcaaccacacctgcctgaccttcaccacgcgggaccccgtccccggagacttggcgcccagcacctccaccaccacccactacatcatgaccatcctgggctgcctctttggcatggttatcgtgctgggagccgtgtactactgcctgcgcaagcggcgcatgcaggaggagaagcagaagtctgtcaacgtcaagaagaccatcctggagatgcgctacggggctgatgtggatgccggctccattgtgcacgccgcccagaagctgggcgagcctcccgtgctgcccgtatctcgcatggcctccatcccctccatgatcggggagaagctgcccaccgccaaggggttggaggccgggctggacacacccaaggtagccaccaaaggcaactatatcgaggtgcgcacaggcgccggcggggacggtctggctcggcccgaggatgacctcccggacctcgagaacggccagggctcggctgcagagatctccaccattgccaaggaggtggacaaggtcaaccagatcattaacaactgcatcgatgctctcaagctggactcggcctcttttctgggaggcggcagcagcagtggggaccccgagctggccttcgagtgccagtccctccctgcagctgctgccgcctcctcagccactggccccggggccctggagcggcccagcttcctttcgcctccctacaaggagagctcccaccacccactacagcgccagctgagcgccgacgcggccgtgacccgcaagacctgcagcgtgtcgtccagtggttccatcaagagcgccaaggtctttagcctggacgtgcccgaccatccggccgccacagggctggctaagggcgactccaagtacatcgagaagggcagccccctcaacagcccgctggaccggctcccgctggtgccggcgggcagcggcgggggcagcggcgggggcgggggcatccaccacctggaggtgaagccggcctaccactgcagcgagcaccggcacagctttcccgccctgtactacgaggagggtgccgacagcctgagccagcgcgtgtccttcctcaagccgctgacccgctccaagcgtgactccacctactcgcagctctcccccagacactactactcagggtactcctccagccccgagtactcatccgagagcacgcacaagatctgggagcgcttccggccctacaagaagcaccaccgggaggaggtgtacatggccgccggtcacgccctgcgcaagaaggtccagttcgccaaggacgaggatctgcatgacatccttgattactggaagggggtctccgcccagcagaagctgtgaccccccccttcctccctggtgaggtcggagccagagggctgggggccttttgggggaagggtccaggcggccagggcggggagcagactcgggggccaaggcccaggagaggacgcacatgcagacccgcacgcacgcacgcacacacacacctgaccaccacccgactgtgaacaaaccaacatccgacaataacggacaggaaaacagagacacattttccttaaagtttacaaactgataccgaaaccagtcgtctttactgtgctgcccagggactctgctggggtgtgcagggccggggggctggcggggggaggaaggaagccaagagagggtgtggggtctggggggtctggggctagaaacaggtgtgggggtcaagaaagctggagtagagagggactgaagcccctctagggcagggagagggtcccttcccaagctgggagtcaagtcacctgcagatttagcattagacatcgggcaatgtctccttccactttagagagggggggaaactgaggcccagagaagggagttgacaaccccagggtcacacagcagcttagcctcaagtcccccaacttcccagcccagtgctgtcccggaaccccctgcagctctcttgtggacccctgcccgccctgtgcccaccccacatccctttccgaagctgtggtcccttggggctgagggacttgggaatcaggcaggtgctttttcttcctagaaagccacatggcagtgcccccagagtgtgcagctgtgattcagaatcctggggggcttttgacccctatgccggcacccgggagaagggagagggtcctgttgacgggaaaggagccgaggcagggcgacattccaccagcccacttcaagtgtcttccacgtggcctgggaagagtggggcgtgtggcgggcaggccagctcccaggacgtctcaggtgcaggctcccggccccagcttctctggtcctccgagacccctgcccaccgcagaagggcagcggtgcactgtgatgcctggagggctgcagggaggagctgtcatgggggacttcctgcctgtccccatggcctgtgtccccacctgcccgaccccatcgtgggatctcggctcctatctcagccgcccacccggggaaggagggctttctcacccatcccctctgggctgctcatccaggcctggccccctggccagaggggctcccatgtttccgtggcaatggccacttccctctttctgacccccccacccaacatcaaacaaagcacaaacagtgaggcccccacccgagagagggttgaggagcaggctgggttcgtggcgccccagcccctcccagccagcctctgtcaccatggtaaccctgtgcctggcagttggtgcccagagtgaccgttgggctctggggttctctgtccatgtaggcggtggcagagggtggtgagggagggccagcctggcagcagctcctggggccagctcttttgggaggcaaatctgcggtcctgagactggggtcttgaccagtcaggatgctgatgggccggagtccatcatccttcacctctgggtgggagctggcccagcggggtgtggggacgcctctactagcagctttgcccgcctagcaacatgtcgcttggctgccacccacctcagcttggggggccccggctctccccacgcccctgccagagacccccagtctagggcctgtggcccacatgggtttcctgagatttggggagtgtgactgaggggcgagggtaggcactggaatgggtccaagaccggcactgttggtgggcaggggctctgaccaggaaagctagtgccatcccctggggaccccaacgaccttcctgctgggggcagggggtgagggaggacagcagagggctaggaggctcgggctcagctgagtacctctctcacaccaactttggggttaacgaagcccagggctcactttgagggtgacatttgcaaagaaaagactgttctcctggggcgaggaggggagggggcggcatggatacgcggagcagacctcctcccccggcccccaaaacctgccccccaacccctcctcacacccccttggcacaactgagaaaagcaagcaggcagagaagccaggggtgtgaggaagcagactccctgttatatttgcatgacgattttactgtatttttctgagcaaacatctgtcgtgtatgtgccagtttgtccagactcccccgccccctctctgatgccctgctttcccacattctgtctgttgtgatctgacgagcagctcttgaaacccagggaggggtcagctctgcaaaaacagacccaaaacaggtgccaccaagacacagccctgccccacacccacctcctgtgtttctgagcattgggcccatgtgccacctcccttcctccctccctctctccactgccacctcccttgtccccagttccttcccctcctccatgccagggagggcagccccagggaagcctcctcaagggctcttgtcccggtggaagggactgtctgtccgtcccgcttgttcccgttttgtagatgaggaagtcagggctcccagacgggcctggtgaattggctggccagctggggtggaggatcagtcacactgctgagtgtaggaggccaggagcttggggcttcgtggggggcttcagggagagggtgggggctttgagaaaggaacccgtgggaagaaggagcacgcctgggctgggccccagggagggttcccagcagcaggagttaggggcctgcgcttgccatttccccatcctttctgcgtgaagatatttaggaaacctcagactctctgactgcagggacaggggcccttccaaagagcaggactctgatgatccaggaggggaactggccttgaagacccagttcatgtggttctttgtgaggcagagcggggtctaagactcgggtctctggcctcccagccaggccagagccccaactgctcagcttggggagagcccacccggaggctggcctgcatctgtgtcccacgtcctgctcaggatgagtttttcccaggcgggagggaagtattcacaaaatgttgccatccaaggtctgggtttgtgatgatgatgagcatggtggagctgggctgtggtctggggcaggccagcagggcagacaccaggaaaagagggcagggggggccacagggagggaggggagatggaggcccggtggagcgagggatgtgtgggtgccacgccctggacctctgcggggaggcctcctgccttgggccggaacaaggtcacacctgggcttgcctgcctctgttggagaatctcctctgaagctgtttctgggaagtagcacaatgggtctgctccttcctgggagggcacagcaggtgcagctaaccctctgttggagcttatggccttccagtagcaaaacacagaggtctggcatgaaggcaagaaagcctggttggtggggaaacctcgtcacgggtcccggccttgcttttccccgcggcaggaagagtctctctctgcccaccaaagaatccctcacctgggctcccctcctgaggcagtgcaggaggcctgtgggagcagcctgtgtccaggctggggagcccgtgtctgggtaggtctgggaaaagggctgtcaggggagcgaggagggtgggagtaaagagacctgcttgggaaggccaggcctggatcgtccccgggaggcagctggggcagcagcagtggggagtatcaggctggccgagagtcacccatgttctcaactggaagttggtcgcctgccccactccctcctggaaatgtaacagcggggtgaacagaagtgcagagacggaaaggagaggaaaggagacctagagctgacaaactcggttgtgacagtgctgaggccgggatggcatcaggaattaaggacaccagtgacaggtcctagcttataaggggcctaagtgcagggaagggataagacacaatgctccctagtgactggcgccttgcagaaaattaaaatagggtgatgggggaggggcaaggctggtcagggagcatcctgtgtgggatggggggacagggagccaagctgtgaatgacaagaggagccagaagggtgggtgggtgggtgggtgtgaagacgagactagagggagtggggttgcagtggctgcctgtcccccaagcaccgcctctgtcccctactaccctgcccctgcccattcctggcccagcagagccccctttccatgagtgtggatgggcggggcaagccgtcggggagcctggggaagctcagccctgaggggcttactttgcccgtggaagccagtgtgaaggttagggcagccttgcctggctggccccattgccacctctcctgtctgacaaggtggctgctccagaggtggctgagccccaggagaggggacctcctctaactctcatgctcagattccatcctgacacactccttccctgaccctgggtgccccttctaagacaaaaccagggtccatactgcttgcctccagaggcggcttcaggcctcactaaaggtcaggcagtcctgctgagcaggagggagaggaagggggtcctgtaggacgggcaggatggtctgggcctgctcctccttcctctgcccctctgccactccacactccagcacagggctgggacaggggcttggagttcctgcagtggcggccacacttccctccctccctcccttcctcaggagccgccagtccccaagttggctgtggttgggcacctggtttgggtcctgcagagctgggctcaggccctgggctctgaacctgtgaacccttgctgtgttacgaaactttccttcctctgagggccttgaaccctctccttttcttcttttgggggtgggggttaactttattttctcttccctgtatctgcctctcccttccctcaatttcctgttttaaaactgaatggcacgaaattgttttcctcaactcggagattcctgtatggagagaatcaatttctatatttgcaataaatttcttatttaaagcta

SEQ ID NO: 131700 - DNA, 8360 bp, Homo sapiens
  Payload ID: 5705
  Gene Symbol: ELFN2
  Gene Name: extracellular leucine-rich repeat and fibronectin type III domain containing 2
  Uniprot ID: Q5R3F8
  ENST ID: ENST00000613079
  CDS Start-End: 787-3249
cacacgcgcgctcccagacacacacacagacacacgcgggccaccccacggccacgcaccccgcacccacacccgcgctcacactcacattcacactcacactcacacgcgcaggccccgcggccgccgcttcccggaggcggtgcttggcccggatcccggctggggctgggaaggagaggacttgggtgaggagctgctgccacccgggctgggccaggacctgagatctcattgctactgctgccgctgctgcctggggaacctttctgagacccaggttggggacagtgccggaggggcctcctctgctgcagacatctggaaccaggtgcagatgggtctcttccttcctgcccccatctctctcactcctggctcagtgcggcactctccagcctcctgtgggaatcatctgaagttctgagcccggaagccaaggaggaagacgaggaggaggaggaggaggaggaggaggaggagggagaggaagtcaagccctgagaacccttgcaccttcctagcaggagacaaggagcaacgctgcggtggggagcaggctgtggggcccccacccccagccctagccaggcctagtgcctgctgtagcaccctagaagatccccagcagttggcactagctgtacccaccttgcctggggcccccgtgctgggggtcgcccccaagatggtggcggccccagggaggactgtactgccagccccagcctctggccgctaggcaccccctgccttgccctggcccctcactccgaggccagcgccatgctgcgcctggggctgtgcgcggcggcgctgctgtgcgtgtgccggccgggtgccgtgcgtgccgactgctggctcattgagggcgacaagggctacgtgtggctggccatctgcagccagaaccagccgccctacgagaccatcccgcagcacatcaatagcaccgtgcacgacctgcggctcaacgagaacaagctcaaagccgtgctctactcctcgctcaaccgctttgggaacctcaccgacctcaacctcaccaagaacgagatctcctacatcgaggacggtgccttcctgggccagtcgagcctgcaggtcctgcagctgggctacaacaagctcagcaacctgacggagggcatgctgcgaggcatgagccgcctgcagttcctctttgtccagcacaacctcatcgaggtggtgacgcccaccgccttctccgagtgcccgagcctcatcagcatcgacctgtcctccaaccgcctcagccgcctggacggtgccacctttgccagcctcgccagcctgatggtgtgtgagctggccggcaaccccttcaactgtgagtgcgacctcttcggcttcctggcctggctggtggtcttcaacaacgtcaccaagaactacgaccgcctgcagtgtgagtcgccgcgggagtttgccggctacccgctgctggtgccccggccctaccacagcctcaacgccatcaccgtactccaggccaagtgtcggaatggctcgctgcccgcccggcccgtgagccaccccacgccctactccaccgacgcccagagggagccagacgagaactcgggcttcaaccccgacgagatcctttcggtggagccgccggcctcgtccaccacggatgcgtcggcagggccagccatcaagctgcaccacgtcacgttcacctcggccaccctggtggtcatcatcccacacccctacagcaagatgtacatcctcgtgcagtacaacaacagctacttctccgacgtcatgaccctcaagaacaagaaggagatcgtgacgctggacaaactgcgggcgcacactgagtacaccttctgcgtgacctcgctgcgcaacagccgccgcttcaaccacacctgcctgaccttcaccacgcgggaccccgtccccggagacttggcgcccagcacctccaccaccacccactacatcatgaccatcctgggctgcctctttggcatggttatcgtgctgggagccgtgtactactgcctgcgcaagcggcgcatgcaggaggagaagcagaagtctgtcaacgtcaagaagaccatcctggagatgcgctacggggctgatgtggatgccggctccattgtgcacgccgcccagaagctgggcgagcctcccgtgctgcccgtatctcgcatggcctccatcccctccatgatcggggagaagctgcccaccgccaaggggttggaggccgggctggacacacccaaggtagccaccaaaggcaactatatcgaggtgcgcacaggcgccggcggggacggtctggctcggcccgaggatgacctcccggacctcgagaacggccagggctcggctgcagagatctccaccattgccaaggaggtggacaaggtcaaccagatcattaacaactgcatcgatgctctcaagctggactcggcctcttttctgggaggcggcagcagcagtggggaccccgagctggccttcgagtgccagtccctccctgcagctgctgccgcctcctcagccactggccccggggccctggagcggcccagcttcctttcgcctccctacaaggagagctcccaccacccactacagcgccagctgagcgccgacgcggccgtgacccgcaagacctgcagcgtgtcgtccagtggttccatcaagagcgccaaggtctttagcctggacgtgcccgaccatccggccgccacagggctggctaagggcgactccaagtacatcgagaagggcagccccctcaacagcccgctggaccggctcccgctggtgccggcgggcagcggcgggggcagcggcgggggcgggggcatccaccacctggaggtgaagccggcctaccactgcagcgagcaccggcacagctttcccgccctgtactacgaggagggtgccgacagcctgagccagcgcgtgtccttcctcaagccgctgacccgctccaagcgtgactccacctactcgcagctctcccccagacactactactcagggtactcctccagccccgagtactcatccgagagcacgcacaagatctgggagcgcttccggccctacaagaagcaccaccgggaggaggtgtacatggccgccggtcacgccctgcgcaagaaggtccagttcgccaaggacgaggatctgcatgacatccttgattactggaagggggtctccgcccagcagaagctgtgaccccccccttcctccctggtgaggtcggagccagagggctgggggccttttgggggaagggtccaggcggccagggcggggagcagactcgggggccaaggcccaggagaggacgcacatgcagacccgcacgcacgcacgcacacacacacctgaccaccacccgactgtgaacaaaccaacatccgacaataacggacaggaaaacagagacacattttccttaaagtttacaaactgataccgaaaccagtcgtctttactgtgctgcccagggactctgctggggtgtgcagggccggggggctggcggggggaggaaggaagccaagagagggtgtggggtctggggggtctggggctagaaacaggtgtgggggtcaagaaagctggagtagagagggactgaagcccctctagggcagggagagggtcccttcccaagctgggagtcaagtcacctgcagatttagcattagacatcgggcaatgtctccttccactttagagagggggggaaactgaggcccagagaagggagttgacaaccccagggtcacacagcagcttagcctcaagtcccccaacttcccagcccagtgctgtcccggaaccccctgcagctctcttgtggacccctgcccgccctgtgcccaccccacatccctttccgaagctgtggtcccttggggctgagggacttgggaatcaggcaggtgctttttcttcctagaaagccacatggcagtgcccccagagtgtgcagctgtgattcagaatcctggggggcttttgacccctatgccggcacccgggagaagggagagggtcctgttgacgggaaaggagccgaggcagggcgacattccaccagcccacttcaagtgtcttccacgtggcctgggaagagtggggcgtgtggcgggcaggccagctcccaggacgtctcaggtgcaggctcccggccccagcttctctggtcctccgagacccctgcccaccgcagaagggcagcggtgcactgtgatgcctggagggctgcagggaggagctgtcatgggggacttcctgcctgtccccatggcctgtgtccccacctgcccgaccccatcgtgggatctcggctcctatctcagccgcccacccggggaaggagggctttctcacccatcccctctgggctgctcatccaggcctggccccctggccagaggggctcccatgtttccgtggcaatggccacttccctctttctgacccccccacccaacatcaaacaaagcacaaacagtgaggcccccacccgagagagggttgaggagcaggctgggttcgtggcgccccagcccctcccagccagcctctgtcaccatggtaaccctgtgcctggcagttggtgcccagagtgaccgttgggctctggggttctctgtccatgtaggcggtggcagagggtggtgagggagggccagcctggcagcagctcctggggccagctcttttgggaggcaaatctgcggtcctgagactggggtcttgaccagtcaggatgctgatgggccggagtccatcatccttcacctctgggtgggagctggcccagcggggtgtggggacgcctctactagcagctttgcccgcctagcaacatgtcgcttggctgccacccacctcagcttggggggccccggctctccccacgcccctgccagagacccccagtctagggcctgtggcccacatgggtttcctgagatttggggagtgtgactgaggggcgagggtaggcactggaatgggtccaagaccggcactgttggtgggcaggggctctgaccaggaaagctagtgccatcccctggggaccccaacgaccttcctgctgggggcagggggtgagggaggacagcagagggctaggaggctcgggctcagctgagtacctctctcacaccaactttggggttaacgaagcccagggctcactttgagggtgacatttgcaaagaaaagactgttctcctggggcgaggaggggagggggcggcatggatacgcggagcagacctcctcccccggcccccaaaacctgccccccaacccctcctcacacccccttggcacaactgagaaaagcaagcaggcagagaagccaggggtgtgaggaagcagactccctgttatatttgcatgacgattttactgtatttttctgagcaaacatctgtcgtgtatgtgccagtttgtccagactcccccgccccctctctgatgccctgctttcccacattctgtctgttgtgatctgacgagcagctcttgaaacccagggaggggtcagctctgcaaaaacagacccaaaacaggtgccaccaagacacagccctgccccacacccacctcctgtgtttctgagcattgggcccatgtgccacctcccttcctccctccctctctccactgccacctcccttgtccccagttccttcccctcctccatgccagggagggcagccccagggaagcctcctcaagggctcttgtcccggtggaagggactgtctgtccgtcccgcttgttcccgttttgtagatgaggaagtcagggctcccagacgggcctggtgaattggctggccagctggggtggaggatcagtcacactgctgagtgtaggaggccaggagcttggggcttcgtggggggcttcagggagagggtgggggctttgagaaaggaacccgtgggaagaaggagcacgcctgggctgggccccagggagggttcccagcagcaggagttaggggcctgcgcttgccatttccccatcctttctgcgtgaagatatttaggaaacctcagactctctgactgcagggacaggggcccttccaaagagcaggactctgatgatccaggaggggaactggccttgaagacccagttcatgtggttctttgtgaggcagagcggggtctaagactcgggtctctggcctcccagccaggccagagccccaactgctcagcttggggagagcccacccggaggctggcctgcatctgtgtcccacgtcctgctcaggatgagtttttcccaggcgggagggaagtattcacaaaatgttgccatccaaggtctgggtttgtgatgatgatgagcatggtggagctgggctgtggtctggggcaggccagcagggcagacaccaggaaaagagggcagggggggccacagggagggaggggagatggaggcccggtggagcgagggatgtgtgggtgccacgccctggacctctgcggggaggcctcctgccttgggccggaacaaggtcacacctgggcttgcctgcctctgttggagaatctcctctgaagctgtttctgggaagtagcacaatgggtctgctccttcctgggagggcacagcaggtgcagctaaccctctgttggagcttatggccttccagtagcaaaacacagaggtctggcatgaaggcaagaaagcctggttggtggggaaacctcgtcacgggtcccggccttgcttttccccgcggcaggaagagtctctctctgcccaccaaagaatccctcacctgggctcccctcctgaggcagtgcaggaggcctgtgggagcagcctgtgtccaggctggggagcccgtgtctgggtaggtctgggaaaagggctgtcaggggagcgaggagggtgggagtaaagagacctgcttgggaaggccaggcctggatcgtccccgggaggcagctggggcagcagcagtggggagtatcaggctggccgagagtcacccatgttctcaactggaagttggtcgcctgccccactccctcctggaaatgtaacagcggggtgaacagaagtgcagagacggaaaggagaggaaaggagacctagagctgacaaactcggttgtgacagtgctgaggccgggatggcatcaggaattaaggacaccagtgacaggtcctagcttataaggggcctaagtgcagggaagggataagacacaatgctccctagtgactggcgccttgcagaaaattaaaatagggtgatgggggaggggcaaggctggtcagggagcatcctgtgtgggatggggggacagggagccaagctgtgaatgacaagaggagccagaagggtgggtgggtgggtgggtgtgaagacgagactagagggagtggggttgcagtggctgcctgtcccccaagcaccgcctctgtcccctactaccctgcccctgcccattcctggcccagcagagccccctttccatgagtgtggatgggcggggcaagccgtcggggagcctggggaagctcagccctgaggggcttactttgcccgtggaagccagtgtgaaggttagggcagccttgcctggctggccccattgccacctctcctgtctgacaaggtggctgctccagaggtggctgagccccaggagaggggacctcctctaactctcatgctcagattccatcctgacacactccttccctgaccctgggtgccccttctaagacaaaaccagggtccatactgcttgcctccagaggcggcttcaggcctcactaaaggtcaggcagtcctgctgagcaggagggagaggaagggggtcctgtaggacgggcaggatggtctgggcctgctcctccttcctctgcccctctgccactccacactccagcacagggctgggacaggggcttggagttcctgcagtggcggccacacttccctccctccctcccttcctcaggagccgccagtccccaagttggctgtggttgggcacctggtttgggtcctgcagagctgggctcaggccctgggctctgaacctgtgaacccttgctgtgttacgaaactttccttcctctgagggccttgaaccctctccttttcttcttttgggggtgggggttaactttattttctcttccctgtatctgcctctcccttccctcaatttcctgttttaaaactgaatggcacgaaattgttttcctcaactcggagattcctgtatggagagaatcaatttctatatttgcaataaatttcttatttaaagct

SEQ ID NO: 131701 - DNA, 1444 bp, Homo sapiens
  Payload ID: 5706
  Gene Symbol: ECM1
  Gene Name: extracellular matrix protein 1
  Uniprot ID: Q16610
  ENST ID: ENST00000346569
  CDS Start-End: 104-1351
acaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttgg

SEQ ID NO: 131702 - DNA, 2070 bp, Homo sapiens
  Payload ID: 5706
  Gene Symbol: ECM1
  Gene Name: extracellular matrix protein 1
  Uniprot ID: Q16610
  ENST ID: ENST00000369047
  CDS Start-End: 126-1748
agaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 131703 - DNA, 1925 bp, Homo sapiens
  Payload ID: 5706
  Gene Symbol: ECM1
  Gene Name: extracellular matrix protein 1
  Uniprot ID: Q16610
  ENST ID: ENST00000369049
  CDS Start-End: 135-1838
aattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtggaaaggagggaagaggccctcgcccccactcccagccctggctaggagaaagggtgggctgctcacacattcccccttctatagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttgg

SEQ ID NO: 131704 - DNA, 3253 bp, Homo sapiens
  Payload ID: 5707
  Gene Symbol: ECM2
  Gene Name: extracellular matrix protein 2, female organ and adipocyte specific
  Uniprot ID: O94769
  ENST ID: ENST00000344604
  CDS Start-End: 151-2250
caaatacttttcaacattcccttctgtcctttctttgtttttaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactgtctcctattctctactcagtggtatagcattaaatgatagaaatgaattttctggtgattcttcagaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggcaattccatcgcctccatcccagatgaagcatttaatggattaccaaatttggaaaggcttgatctgagtaaaaataatatcacttcttcaggcataggtccaaaagcattcaagcttctgaagaagttaatgcgtttgaatatggatggaaataatttgatacagattccttcacaattgccatctacattagaagaacttaaagtcaatgagaacaatcttcaggctatcgatgaagaaagtttatcagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggaattatacctagaaaataaccaaattgaagaaataactgaaatttgtttcaatcataccagaaagatcaatgtcattgtactacgttataacaaaattgaagaaaataggattgctcctttagcctggataaatcaagaaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacggaacattcttccagaagaaatttgcaatgctgaagaggatgatgactcaaatctggaacatcttcatcttgaaaacaattatattaaaattagagaaataccatcttacacattttcatgcataagatcatactcaagtatcgttcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggtatagtctctaggagttttattaatagtaaaggtaaaatctctcagtttcctacctctagaaagaggccatctcactagaataggatattatgcatactgagctagaccagaagagtctggaacaaaataaacacagcctttataatcaacttgaatactggtgttagctgagaactctgtaagtccctttaaaaattatgtatcttttggttcaagattaagaagcataatgacaacaaaaaaagcaggcagaatttatgaataagtgttgtttattattaaaacaataatttgttaatttcttataaggtcctgtgctataattactggtataaatataactgaatattggggtagctttcatttcttccattaattacatgtgtaaaattaaaacactactgtaatgttaatttcctggttttgaaaatcatattatggttatgtacattgttaacattaaggaaagctggcagaagggtgtgcataaattctatactctttttgaaacttttctataattctaaaattattttttaaagttaaacagtatattaagattaccttcactattcctcactcaagattaagacattttttgaaaagcagtagagtttgcttaaaatacaaattaattattcttgactataaccttgtaaaggtaaatctaatgtataaatttttgaaaaattttgcaccactggtcatagcatctatctcctttgccttaatttactgaaatacatcattttattcggttcaattgaaataaagctatgtctttactatgtattggccctaccaaaatcatatattaaaattttctaacataatga

SEQ ID NO: 131705 - DNA, 1606 bp, Homo sapiens
  Payload ID: 5707
  Gene Symbol: ECM2
  Gene Name: extracellular matrix protein 2, female organ and adipocyte specific
  ENST ID: ENST00000375540
  CDS Start-End: 151-645
caaatacttttcaacattcccttctgtcctttctttgtttttaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactggtacagagatttagctaagcaaaatatcagtgtgtgattaatctttaacttccatttgtttttgttactaattttagattaaaattatgatacattagtcagatctgagtacttaaaatattggcaaaatgctgattaacatagaaaatatctgggaaaatgtatggtaggggatataaataatagactgtggctttatagttctagctctatcagattcagtaaacttggatgagattacattccacatttgactctcagctttagagatatggtaacagaatttctacaacagatcctgaattcttattgcattaagggctctgctttggtctatatgtgcattatcccacttaatccagtgcaacgtgcctttatcatcttgaagccagggtaaacaaaggaagagtgatttgcatctaaagagaacaaagccccaaccctctggctatacccaaccactcaaaggcagcacaggaacccacatcactgcttggataatcccaggaaaatgcagaaaaagtgtagcctgaagcatgattttctcatgtggcacttctgtgtgcaggagatcacagcgcgggttttgttggctgctcatggaccccttctccaatgaggctcatacctgactgaatgaaggacccttgggagggaggcccagtctcctctgagaaaagcctaaccaacaccttatgaaaataagcaaataaatacttgttaaataattggctgggaagggatagggacatcttctcttgtctataaccaaggtagattgctcccatgcacacagatgatcacagggtaggtgtctacaaaagtctccttgccaggaaaaacttttgactatttagaaattgtgttttgcgttatactaccaaatatttcactaatatttaaaaagagttaggaaaaaagtgttcaatgaaatggattccttggagtgaaataaatacaaggtttacaaagtaa

SEQ ID NO: 131706 - DNA, 612 bp, Homo sapiens
  Payload ID: 5707
  Gene Symbol: ECM2
  Gene Name: extracellular matrix protein 2, female organ and adipocyte specific
  ENST ID: ENST00000395534
  CDS Start-End: 133-612
tttgcagataaagaaactgaggccaaagtacacaactaatttgccagcgtaacagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctact

SEQ ID NO: 131707 - DNA, 2648 bp, Homo sapiens
  Payload ID: 5707
  Gene Symbol: ECM2
  Gene Name: extracellular matrix protein 2, female organ and adipocyte specific
  Uniprot ID: O94769
  ENST ID: ENST00000444490
  CDS Start-End: 188-2119
gggaggcagttattttagattttactaagaagttcagcaaatacttttcaacattcccttctgtcctttctttgtttttaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactgaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggcaattccatcgcctccatcccagatgaagcatttaatggattaccaaatttggaaaggcttgatctgagtaaaaataatatcacttcttcaggcataggtccaaaagcattcaagcttctgaagaagttaatgcgtttgaatatggatggaaataatttgatacagattccttcacaattgccatctacattagaagaacttaaagtcaatgagaacaatcttcaggctatcgatgaagaaagtttatcagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggaattatacctagaaaataaccaaattgaagaaataactgaaatttgtttcaatcataccagaaagatcaatgtcattgtactacgttataacaaaattgaagaaaataggattgctcctttagcctggataaatcaagaaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacgctgtgtttcagatgctgttctagagacagtgacaaacagatcagatgtggcctttcctctctggtagaggcaataagcaggaaatcaaacagacaagtaagcaggcaagtgctgtgcagtcagaaaaatgggtgacaatgcgacgagcacactggggcctgagggccgccaggagactacggccaccctcaacggcctggattaacagcagatccagaccggtgcctgtggagcagacgcactgtgggcttgctgtgtatgtcgcttctcaactctgctctggctgcagaatcccaagaaaaaaatgaaaatcagaatgactgattgaagcttttttcttaagtggaagttgtacttatttctactgattttataatttttaaaatatggctagcatggaacttgttcagccctgaaatttcatgatgttctagatgggaagttttaattccataaaaaagtgataaatgtccttatagcaaacactcttcacaatataatgtactaaaaaacagatgttctgtttggcttcaaaaattacactataattactaacacacatatacactaaagaagtcctggtctagccatgatct

SEQ ID NO: 131708 - DNA, 3930 bp, Homo sapiens
  Payload ID: 5708
  Gene Symbol: EYA1
  Gene Name: EYA transcriptional coactivator and phosphatase 1
  ENST ID: ENST00000303824
  CDS Start-End: 269-2029
cgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaaaccatacccacatattctccctaccccttcctcacaaactatggctgcatatgggcaaacacagtttaccacaggaatgcaacaagctacagcctatgccacgtacccacagccaggacagccgtacggcatttcctcatatggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgta

SEQ ID NO: 131709 - DNA, 4326 bp, Homo sapiens
  Payload ID: 5708
  Gene Symbol: EYA1
  Gene Name: EYA transcriptional coactivator and phosphatase 1
  Uniprot ID: Q99502
  ENST ID: ENST00000340726
  CDS Start-End: 641-2419
aaaccaataaggttaggacaagagaatagctgtggtttgcgttgcaaaaaccaaaaaaaaaaaaaaaaaaaaaaaaagaaagccccgaggctccatgggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 131710 - DNA, 3788 bp, Homo sapiens
  Payload ID: 5708
  Gene Symbol: EYA1
  Gene Name: EYA transcriptional coactivator and phosphatase 1
  Uniprot ID: Q99502
  ENST ID: ENST00000388740
  CDS Start-End: 204-1883
aaacaacagttgagacctcaacttaaagacaatatgcctttcactgctgcagtatcctcctttttctcttttggttaaaagagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgt

SEQ ID NO: 131711 - DNA, 3404 bp, Homo sapiens
  Payload ID: 5708
  Gene Symbol: EYA1
  Gene Name: EYA transcriptional coactivator and phosphatase 1
  ENST ID: ENST00000388741
  CDS Start-End: 516-2192
gggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaaaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctc

SEQ ID NO: 131712 - DNA, 3907 bp, Homo sapiens
  Payload ID: 5708
  Gene Symbol: EYA1
  Gene Name: EYA transcriptional coactivator and phosphatase 1
  Uniprot ID: Q99502
  ENST ID: ENST00000388742
  CDS Start-End: 222-2000
gagacctcaacttaaagacaatatgcctttcactgctgcagtatcctcctttttctcttttggttaaaagagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 131713 - DNA, 2199 bp, Homo sapiens
  Payload ID: 5708
  Gene Symbol: EYA1
  Gene Name: EYA transcriptional coactivator and phosphatase 1
  ENST ID: ENST00000388743
  CDS Start-End: 153-1928
gagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaaaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactaca

SEQ ID NO: 131714 - DNA, 1723 bp, Homo sapiens
  Payload ID: 5708
  Gene Symbol: EYA1
  Gene Name: EYA transcriptional coactivator and phosphatase 1
  Uniprot ID: Q99502
  ENST ID: ENST00000419131
  CDS Start-End: 30-1703
atgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgaca

SEQ ID NO: 131715 - DNA, 3743 bp, Homo sapiens
  Payload ID: 5708
  Gene Symbol: EYA1
  Gene Name: EYA transcriptional coactivator and phosphatase 1
  ENST ID: ENST00000465115
  CDS Start-End: 140-778
aaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaatttaccacaggaatgcaacaagctacagcctatgccacgtacccacagccaggacagccgtacggcatttcctcatatggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 131716 - DNA, 879 bp, Homo sapiens
  Payload ID: 5708
  Gene Symbol: EYA1
  Gene Name: EYA transcriptional coactivator and phosphatase 1
  ENST ID: ENST00000493349
  CDS Start-End: 320-445
ttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagagtcaagggcttccagagagtccatgatgctggtgaagctgggcagaagaaagcctagcagcgcttgagctcttcatgaggtctatttgaaagcacagtgagggcttggacgtgcccttagaaagcacaatggaatcatgctgttctgcatcagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtga

SEQ ID NO: 131717 - DNA, 1540 bp, Homo sapiens
  Payload ID: 5709
  Gene Symbol: EYA2
  Gene Name: EYA transcriptional coactivator and phosphatase 2
  ENST ID: ENST00000317304
  CDS Start-End: 11-1537
gtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcag

SEQ ID NO: 131718 - DNA, 2702 bp, Homo sapiens
  Payload ID: 5709
  Gene Symbol: EYA2
  Gene Name: EYA transcriptional coactivator and phosphatase 2
  Uniprot ID: O00167
  ENST ID: ENST00000327619
  CDS Start-End: 375-1991
gcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 131719 - DNA, 2465 bp, Homo sapiens
  Payload ID: 5709
  Gene Symbol: EYA2
  Gene Name: EYA transcriptional coactivator and phosphatase 2
  Uniprot ID: O00167
  ENST ID: ENST00000357410
  CDS Start-End: 375-1754
gcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 131720 - DNA, 592 bp, Homo sapiens
  Payload ID: 5709
  Gene Symbol: EYA2
  Gene Name: EYA transcriptional coactivator and phosphatase 2
  ENST ID: ENST00000458636
  CDS Start-End: 1-592
cagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggagg

SEQ ID NO: 131721 - DNA, 2384 bp, Homo sapiens
  Payload ID: 5709
  Gene Symbol: EYA2
  Gene Name: EYA transcriptional coactivator and phosphatase 2
  Uniprot ID: O00167
  ENST ID: ENST00000497062
  CDS Start-End: 129-1673
ggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttccttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 131722 - DNA, 2612 bp, Homo sapiens
  Payload ID: 5709
  Gene Symbol: EYA2
  Gene Name: EYA transcriptional coactivator and phosphatase 2
  ENST ID: ENST00000611592
  CDS Start-End: 375-1901
gcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 131723 - DNA, 1729 bp, Homo sapiens
  Payload ID: 5710
  Gene Symbol: EYA3
  Gene Name: EYA transcriptional coactivator and phosphatase 3
  Uniprot ID: Q99504
  ENST ID: ENST00000373863
  CDS Start-End: 110-1720
ctgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttgcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcaactctatttcttagacatggaggcattgggttgccagctagaaccaactgccctgatactcttcatccagttaagtggaaaccttagcaactataataaactatgagattggtaa

SEQ ID NO: 131724 - DNA, 2459 bp, Homo sapiens
  Payload ID: 5710
  Gene Symbol: EYA3
  Gene Name: EYA transcriptional coactivator and phosphatase 3
  ENST ID: ENST00000373864
  CDS Start-End: 211-1461
aaactgctgagagagacttgcaatccagtcacataagtataataaagaaatattggtcctcatggaagaagagcaagatttaccagagcaaccatcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaacttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctgacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgaga

SEQ ID NO: 131725 - DNA, 6085 bp, Homo sapiens
  Payload ID: 5710
  Gene Symbol: EYA3
  Gene Name: EYA transcriptional coactivator and phosphatase 3
  Uniprot ID: Q99504
  ENST ID: ENST00000373871
  CDS Start-End: 242-1963
aggtttctagtggaacgaggtgtggattgtgaggtgactctggccgcttacttccggttcctagcgatgcgcatccgggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcgtgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctata

SEQ ID NO: 131726 - DNA, 5943 bp, Homo sapiens
  Payload ID: 5710
  Gene Symbol: EYA3
  Gene Name: EYA transcriptional coactivator and phosphatase 3
  Uniprot ID: Q99504
  ENST ID: ENST00000436342
  CDS Start-End: 262-1824
cctagcgatgcgcatccgggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagttatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcgtgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttct

SEQ ID NO: 131727 - DNA, 5885 bp, Homo sapiens
  Payload ID: 5710
  Gene Symbol: EYA3
  Gene Name: EYA transcriptional coactivator and phosphatase 3
  Uniprot ID: Q99504
  ENST ID: ENST00000540618
  CDS Start-End: 183-1766
cctagcgatgcgcatccgggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttgcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcgtgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttct

SEQ ID NO: 131728 - DNA, 5692 bp, Homo sapiens
  Payload ID: 5711
  Gene Symbol: EYA4
  Gene Name: EYA transcriptional coactivator and phosphatase 4
  Uniprot ID: O95677
  ENST ID: ENST00000355167
  CDS Start-End: 459-2378
gcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggaggggaaaacatgactgttttaaacacagcagactggttgctgagttgcaacaccccctcttctgcaacaatgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggcaaggaaagctgttttgagcgtatagtgtccagatttggcactaacataacttatgttgtgattggagatggccgagatgaggagcatgccgctaaccagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccatggcaaaaatgataatatcatcagaaatggaaggcagttctcccagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgcaggttctcctcgtaacagacttgcatatgtttgttagtttctgcctgtattgtcactgcgcaacggatggcattcattacaagaagagcccatcatcgttgtgtttgcatggtttttttccttgtgtgtagcccatgttgggaacacgatacaggttctcctcttatttcctatgacacgatttcccttgtggaaatttaagactttaagaactagagtatttttatggtgtctgcacctgcagttctgtgtttaaaatgtcataatgtggatcctggagtcaggctactagtcagtgcccctagccagaggctggttcatgagttcatcaactgaggcctctgtggcttcaataaagtctacattttgctcacagatcacaacattcactgtggaaatatgatttcatttctttaggctacaaacctgtatttctttactgaatgctaaggccatgtttatattgggtagaaagatattgagatcccaattttgtacaagattgtgatttcattatctaaaccttaaacttaatcctttaaattttgtagcttttggctgcatctgccccaagtactattccaggcaaattaaagttggaatacctttaataatataaaaataatgatagtaaatcttatacttctgttggcccttagcttgaaaatagcagttaaaaaaatttaaatgttgccttgattatcagtacttaattatgttgtgcactaaaaccttaaatatttattactgtgaataaaaacaaattatctttactgtatagctggtttctttaaatgttgatagaattgtggcattacatctaaatttgtaagtcttttcatatcaaacaagcaaggctttttatgctgctaagtctgtgggtgcagaaagaaacaccccttggaagggcaaagagaagccggctggttgcatcaccccgtgcagtttctcacacacatctctttttctgattctgtgttcagaagaggctgccggcataaaacctaaatgcaaggttgacggagaacagcttgtctggcacaacaatggtgcaggcccacgagccagcatcacagcttggccatgggacgttgagtatgcacaaactagaactcttcccttcccaccttaggaatagaaaatcctcttcctttctaatctgaaaaacgaaaactgaacaaacacaaaaccaaccccttggcagttcccacctcctattgacatatggaatattgtgccttattgtaaaccagtttgaaaaatgttctgtaactaaagtgggttttcggctattatgtatacagcttggtatattactacgaaagataaccaccttgtgttgcaccttaaaaatatcaagaccatgtaatttccataacaaaataggtggcctggctatggtattatagcatacaattaggacactatgcccctgcaaaattttgtaaatcaaattcagaggcaaaaacatattttagaatcatacagtttgcacacgacaagtaggtaataactgtctctaaaaatgttttctccttagtccgcaatgagctaagattcagaatagtgtcaacagcatgctcctatatgaagttgttttttttaaagcacatttgtttatgacaagcctacattctcagtgaatatggcatttagtatttcttttgaaaacaaacttaagcatcatgagccaaagttgcactttgactcccaactacggtagcattatggacatctcacaatgtcaagggtttctgttatgtattagtaaagtatagattattggggcctacataatttaaaagaaatgtaaattaatattaaaagcttgtaaaaatatgtatatctttactatttctcaataaatacctttgcaattgttttcatttccttc

SEQ ID NO: 131729 - DNA, 4317 bp, Homo sapiens
  Payload ID: 5711
  Gene Symbol: EYA4
  Gene Name: EYA transcriptional coactivator and phosphatase 4
  Uniprot ID: O95677
  ENST ID: ENST00000355286
  CDS Start-End: 398-2248
gggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggagtgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccatggcaaaaatgataatatcatcagaaatggaaggcagttctcccagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgcaggttctcctcgtaacagacttgcatatgtttgttagtttctgcctgtattgtcactgcgcaacggatggcattcattacaagaagagcccatcatcgttgtgtttgcatggtttttttccttgtgtgtagcccatgttgggaacacgatacaggttctcctcttatttcctatgacacgatttcccttgtggaaatttaagactttaagaactagagtatttttatggtgtctgcacctgcagttctgtgtttaaaatgtcataatgtggatcctggagtcaggctactagtcagtgcccctagccagaggctggttcatgagttcatcaactgaggcctctgtggcttcaataaagtctacattttgctcacagatcacaacattcactgtggaaatatgatttcatttctttaggctacaaacctgtatttctttactgaatgctaaggccatgtttatattgggtagaaagatattgagatcccaattttgtacaagattgtgatttcattatctaaaccttaaacttaatcctttaaattttgtagcttttggctgcatctgccccaagtactattccaggcaaattaaagttggaatacctttaataatataaaaataatgatagtaaatcttatacttctgt

SEQ ID NO: 131730 - DNA, 5699 bp, Homo sapiens
  Payload ID: 5711
  Gene Symbol: EYA4
  Gene Name: EYA transcriptional coactivator and phosphatase 4
  Uniprot ID: O95677
  ENST ID: ENST00000367895
  CDS Start-End: 465-2384
ttccgcgcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggaggggaaaacatgactgttttaaacacagcagactggttgctgagttgcaacaccccctcttctgcaacaatgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccatggcaaaaatgataatatcatcagaaatggaaggcagttctcccagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgcaggttctcctcgtaacagacttgcatatgtttgttagtttctgcctgtattgtcactgcgcaacggatggcattcattacaagaagagcccatcatcgttgtgtttgcatggtttttttccttgtgtgtagcccatgttgggaacacgatacaggttctcctcttatttcctatgacacgatttcccttgtggaaatttaagactttaagaactagagtatttttatggtgtctgcacctgcagttctgtgtttaaaatgtcataatgtggatcctggagtcaggctactagtcagtgcccctagccagaggctggttcatgagttcatcaactgaggcctctgtggcttcaataaagtctacattttgctcacagatcacaacattcactgtggaaatatgatttcatttctttaggctacaaacctgtatttctttactgaatgctaaggccatgtttatattgggtagaaagatattgagatcccaattttgtacaagattgtgatttcattatctaaaccttaaacttaatcctttaaattttgtagcttttggctgcatctgccccaagtactattccaggcaaattaaagttggaatacctttaataatataaaaataatgatagtaaatcttatacttctgttggcccttagcttgaaaatagcagttaaaaaaatttaaatgttgccttgattatcagtacttaattatgttgtgcactaaaaccttaaatatttattactgtgaataaaaacaaattatctttactgtatagctggtttctttaaatgttgatagaattgtggcattacatctaaatttgtaagtcttttcatatcaaacaagcaaggctttttatgctgctaagtctgtgggtgcagaaagaaacaccccttggaagggcaaagagaagccggctggttgcatcaccccgtgcagtttctcacacacatctctttttctgattctgtgttcagaagaggctgccggcataaaacctaaatgcaaggttgacggagaacagcttgtctggcacaacaatggtgcaggcccacgagccagcatcacagcttggccatgggacgttgagtatgcacaaactagaactcttcccttcccaccttaggaatagaaaatcctcttcctttctaatctgaaaaacgaaaactgaacaaacacaaaaccaaccccttggcagttcccacctcctattgacatatggaatattgtgccttattgtaaaccagtttgaaaaatgttctgtaactaaagtgggttttcggctattatgtatacagcttggtatattactacgaaagataaccaccttgtgttgcaccttaaaaatatcaagaccatgtaatttccataacaaaataggtggcctggctatggtattatagcatacaattaggacactatgcccctgcaaaattttgtaaatcaaattcagaggcaaaaacatattttagaatcatacagtttgcacacgacaagtaggtaataactgtctctaaaaatgttttctccttagtccgcaatgagctaagattcagaatagtgtcaacagcatgctcctatatgaagttgttttttttaaagcacatttgtttatgacaagcctacattctcagtgaatatggcatttagtatttcttttgaaaacaaacttaagcatcatgagccaaagttgcactttgactcccaactacggtagcattatggacatctcacaatgtcaagggtttctgttatgtattagtaaagtatagattattggggcctacataatttaaaagaaatgtaaattaatattaaaagcttgtaaaaatatgtatatctttactatttctcaataaatacctttgcaattgttttcatttccttca

SEQ ID NO: 131731 - DNA, 2364 bp, Homo sapiens
  Payload ID: 5711
  Gene Symbol: EYA4
  Gene Name: EYA transcriptional coactivator and phosphatase 4
  ENST ID: ENST00000430974
  CDS Start-End: 465-2177
ttccgcgcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggtacagatcttcacccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggcaaggaaagctgttttgagcgtatagtgtccagatttggcactaacataacttatgttgtgattggagatggccgagatgaggagcatgccgctaaccagaagaggctgccggcataaaacctaaatgcaaggttgacggagaacagcttgtctggcacaacaatggtgcaggcccacgagccagcatcacagcttggccatgggacgttgagtatgcacaaactagaactcttcccttcccaccttaggaatagaaaatcctcttcctttctaatctgaaaaacgaaaactgaacaaacacaaa

SEQ ID NO: 131732 - DNA, 2411 bp, Homo sapiens
  Payload ID: 5711
  Gene Symbol: EYA4
  Gene Name: EYA transcriptional coactivator and phosphatase 4
  Uniprot ID: O95677
  ENST ID: ENST00000452339
  CDS Start-End: 557-2314
gttgctgcctgacctttgggcgtctgggacggatgcctatacctgcacccagcagcactggaaggggcccaggcccttcgcagcacagcctatccccagaccgcttagtccttcataacatatatctccacggaaaagggtatttcctcccgtcagaaaaagcgccccagtctggtctgggttggtttttatttcacgttgttgcaagtaggcgaagtcccttctgtctcctcccttgggtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggcaaggaaagctgttttgagcgtatagtgtccagatttggcactaacataacttatgttgtgattggagatggccgagatgaggagcatgccgctaaccagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtct

SEQ ID NO: 131733 - DNA, 2154 bp, Homo sapiens
  Payload ID: 5711
  Gene Symbol: EYA4
  Gene Name: EYA transcriptional coactivator and phosphatase 4
  Uniprot ID: O95677
  ENST ID: ENST00000431403
  CDS Start-End: 1-1920
atggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggaggggaaaacatgactgttttaaacacagcagactggttgctgagttgcaacaccccctcttctgcaacaatgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggcaaggaaagctgttttgagcgtatagtgtccagatttggcactaacataacttatgttgtgattggagatggccgagatgaggagcatgccgctaaccagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaat

SEQ ID NO: 131734 - DNA, 2892 bp, Homo sapiens
  Payload ID: 5711
  Gene Symbol: EYA4
  Gene Name: EYA transcriptional coactivator and phosphatase 4
  ENST ID: ENST00000531901
  CDS Start-End: 230-2167
tttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggaggggaaaacatgactgttttaaacacagcagactggttgctgagttgcaacaccccctcttctgcaacaatgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggtacagatcttcacccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaa

SEQ ID NO: 131735 - DNA, 3456 bp, Homo sapiens
  Payload ID: 5711
  Gene Symbol: EYA4
  Gene Name: EYA transcriptional coactivator and phosphatase 4
  ENST ID: ENST00000525849
  CDS Start-End: 185-2035
cacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggagtgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttggccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggcaaggaaagctgttttgagcgtatagtgtccagatttggcactaacataacttatgttgtgattggagatggccgagatgaggagcatgccgctaaccagcacaacatgcccttctggaggatatccagtcactcagacctcctggctctccaccaagcactggaattagagtatttgtaactgtgttctttagccggagatccattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccatggcaaaaatgataatatcatcagaaatggaaggcagttctcccagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgca

SEQ ID NO: 131736 - DNA, 2168 bp, Homo sapiens
  Payload ID: 5712
  Gene Symbol: EYS
  Gene Name: eyes shut homolog (Drosophila)
  Uniprot ID: Q5T1H1
  ENST ID: ENST00000342421
  CDS Start-End: 333-2117
gtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccaggtatttatgtatcatttgagcagataatatcacatatcaaaaagttataattaaattgatagtcatcgaa

SEQ ID NO: 131737 - DNA, 9498 bp, Homo sapiens
  Payload ID: 5712
  Gene Symbol: EYS
  Gene Name: eyes shut homolog (Drosophila)
  Uniprot ID: Q5T1H1
  ENST ID: ENST00000370616
  CDS Start-End: 1-9498
atgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagcacttatcctcattgtgatcttggaaaagccaaaaccagcagaacggaaagtgaagaaggaggctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataa

SEQ ID NO: 131738 - DNA, 9435 bp, Homo sapiens
  Payload ID: 5712
  Gene Symbol: EYS
  Gene Name: eyes shut homolog (Drosophila)
  Uniprot ID: Q5T1H1
  ENST ID: ENST00000370618
  CDS Start-End: 1-9435
atgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataa

SEQ ID NO: 131739 - DNA, 10485 bp, Homo sapiens
  Payload ID: 5712
  Gene Symbol: EYS
  Gene Name: eyes shut homolog (Drosophila)
  Uniprot ID: Q5T1H1
  ENST ID: ENST00000370621
  CDS Start-End: 528-10025
gatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagcacttatcctcattgtgatcttggaaaagccaaaaccagcagaacggaaagtgaagaaggaggctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataagttaacactagagattttagtacacactatacataaatgcagttattttgatagttatttctttgatacattgcttacggggaatcaactgtttactatattacctgaaatagtctaaatgctaacatatctttttgataagattgtaaaatgtcactgaaggttctgattgtttttcctacatctaatttatctgtatatattttgattcatgttttaactccattagttcagtgcttattcacagaatgtgcttattcactttgcttattcactttttacctatccctaatgcttacattttaaaatcaacgtgtaaacacaattttaaaaatcaatgtgtaagctgaactttaaaatgtttaaaattcagttgggaatgaattagggataggtacaaataagaaaaaaatcaagttattaatcaaaggaaaaataaaaattatacaaagcaatgtaa

SEQ ID NO: 131740 - DNA, 5450 bp, Homo sapiens
  Payload ID: 5712
  Gene Symbol: EYS
  Gene Name: eyes shut homolog (Drosophila)
  Uniprot ID: Q5T1H1
  ENST ID: ENST00000393380
  CDS Start-End: 539-2398
agaaacaaagtgatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagaagaatcctcaacacggtgataccacaccaaattcagcaacatatagaaaggtttatacagcatgaccaggtgggatttatcgtaagaatataagtttgatttagtggcttaaaatcaattaatgtaatttaatgtatcaatagaataaataaagaagaaaatgcatgataatgtagatggagaaaaaaattgtattacagaatctcacaacactttatgaaacaaacactcaacaaataaagaataaaagggaacttccacaatctgataagagaagttaaaaaaaaataagaagaatgaagaaacataactaacattatactttacggtgaaaggctgaaagactggaattttaaatcaaaacaatgagataacactttacacccagcaattctacttctagtatatactcaaaaaattgaaaatatatgttctttacaaaaatttatatgtgaatgtttacagttttgttcgaaagagtcaaaaagttgaaacaacccaaatgaccatcaactgatgaatggatatataaaatttgttatatccatacaatgaaatgttattcagcaatagacaaagatgaattactgatatgtgcttcaatacgaataaacattgaaaacattttgataaggaaaagtagtaagccacaaaagacacatagaatagtgctcaacaaatacttgtttaatgaaacaatgattttcagaagcttttttatttactaagaaaattatccttcgttttgtgatgttatttccttttttctgattttgtgattctcttttgtttgccattattttttgatatccagagaatcttggataaattacaaaatttttgtaatttatcaacactttaatgagttcttgatattgtctcataattaatactaacaatggagcccaacaaatgttgcagatacaagtattttatataaaattaagtttctctatatcagttgcaatatctagaaattatatgtgtgataccacctgttataatgtcaaaagatatgcaaaatgtttagaattaaaaaaaagatgctctaattctccattaaaaagaccctctatataccactaagctcaatgaaaaagagaaaattatatatacactgaataaatggaaatataatgcatggagttaaatattaggccttaaattagctaaaatattaattcttcccaaattaattcacacatttaatgcaatagtaaaaatattgcaagttattttagaaactaattatcatgttatatatatttatgaataatattttctaaattatgaagtcatctttgaaaaggaagactaatggggtgggatctgatgaaccatatgacatgacagactacataacacatatgggtgcctttaaaggaaaaaaaataataatgggtcaacagagagctctgacaacaacccgagtatatacgggaactcaatatatgagaaatttggctataatctcatttgaacatacagggttctttagtaaatggtattgaggaaatggctcataataagaccttaaatgaaactggattacaaccttataccttatatagaagtagactctaaatgtgtatagggatctaaaagtttaaggtaaaatgacgatataaatgaaagaaatgtagaaaaatatctttgtgatttcgggatggagaaatttttcaattaaactcaatttataaggcaaaataatgatagtattataatgatagacactaataatgttgatgatgttaacggacacaaagttaatgaatagcgtataaacattttcttttaaagtgtattttaaatgggtgcagattaaaattcattatataaatgatgtattgcaaacaggtctgcatattaccacatttttttgccctgaaatcttcaaaaaatttttctgggggtttataaaatgtttaatgagccaaagactaaatcataccagccatattgttacttaagaccaggaaagatttgctaagtctgggatgttaatttcttaataccatgcccagactgtgaagtgttcatgactcccacctgtttttgaagcctcaaatttatgtctaagtcaccaatccctacttgctaccagaaatatcataacagaatgaaatatattcattcatacatttattatttattgaatctcctctaactggaagatatttttcaaaatgttatgacaatgagacatgatacctgtccccaggtaatgtactatacataggtaagattatacactcttcagaacacatctcatggttcttctgtttcatttagaaagtgaacacatttttaaagtactaaagtaattatttttttcactttctgaacatacaagttgcttgattatagcagtgtgtcttctggctttctttctggaagttttaaatttaacctgtttcctttacaggctattttaggagattcacattttctgtgtaatgttaaatatatccaaaacataattttcagttataagtaagagttctgtttcaaagtgtagaatctaaaagtccataagaaaatcaggtgaagtttcaaaaactatttctgtagagtcaggaggcttgtaaaaatagagctttatgtgaatatggcacaaaagtatagtataatttgaccaggattttcttaaattatttctgatcccaaaagtctaataattatttattctaagactattgtaatttctgccgtgatgtccgtgattttattaacaagttgaatagttggttttaggtttatttatttattttggctatactatgcaaacttttctgccttcaagtaaaagttttatgtgggtatatttttacctttaaagcaaaaaagatatcgaactgcatatgaaagtgtcatattgaatgtatttttgggttggggccagtcttgaaaccactagatcaagtgtctaaatctttttgtctaaggcacttacatacactgatatattttctctctttattatgctctagaaaaccaaataatcttggttcttaaatccttatagtaaaatgatatagaaatcattcatttaagcaattctagagtacatatcattgtattacccatacacataccaaaattattataacaaacttcattaaatgaagcatttttgaataataaa

SEQ ID NO: 131741 - DNA, 2295 bp, Homo sapiens
  Payload ID: 5712
  Gene Symbol: EYS
  Gene Name: eyes shut homolog (Drosophila)
  ENST ID: ENST00000398580
  CDS Start-End: 1-1420
cagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaaggtcatcaatttattggaaaagatgttttcaaataatttatccaacatttttggtggttttcatgatggagatgaggtaaatcatgttatctaatctactatactgctggaaacaaaagtcaactattggatttattttaaaagaagcccatctggccgggcgcagtggctcatgcctgtaatctcagcactttgggaggccaaggcgggcaaatcacctgaggtcaggagttcgagaccagcttggccaacatggggaaaccccgtctctactaaaaacacaaaaattagccgggtgtagtggtgggcgcccgtaatcccagctactcgggaggctgaggcaggagaatcgcttgaacccaggaggcagaggttgcagtgagccaagattgcgccactgcactccaacatgggtgacagagcagaactctgtctcagaaaaaaaaaaaaaagaaagaaagaagcccttctgaccagtattgcataaagcattaaaaactatagaagaaagttaaaagtgctatgagaggacattgcaagtgggaacaccatcacttggtcccaagttttgaggagcagatactgctagaccctgatcagtgattttaagggtagggaagggacactgataaagaaaaaggtccttccatagtagtacatttaatgtgccagcctgtaacttatccctccatcctcattaaagcagcaagaaagaagataaaacagtgtcctttttcctttttaaaatgcatttggtgtaaaaaataatgaggtatgcccaatatcatggtaactcaaagacagcttaactgatgaattaaaaattaaagtatgcttgaacacaagcaagatatggagtatgcatgagaaaaaaatacattataataaaaagaaaagagaagccactaaaa

SEQ ID NO: 131742 - DNA, 1253 bp, Homo sapiens
  Payload ID: 5712
  Gene Symbol: EYS
  Gene Name: eyes shut homolog (Drosophila)
  ENST ID: ENST00000471279
  CDS Start-End: 534-992
taaaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccgctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacagggttgcttggaggcaaatgaagaaaaaagttctgcattagtgaggcagggatgtcagtatataaggaatttgaaagacatcaatgataatggcaaaaactgctcataaattaaattaagagcttaattaaactggggaaaaaaacatattgccaaattacatgcagttggtttgtaacagcatttgtccacttgctatgccctgggattttcaaggcacattcctctactaaggaaagaattgctcagaaataattggccagtgtcaaccacatgtctgtt

SEQ ID NO: 131743 - DNA, 10589 bp, Homo sapiens
  Payload ID: 5712
  Gene Symbol: EYS
  Gene Name: eyes shut homolog (Drosophila)
  Uniprot ID: Q5T1H1
  ENST ID: ENST00000503581
  CDS Start-End: 539-9973
agaaacaaagtgatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataagttaacactagagattttagtacacactatacataaatgcagttattttgatagttatttctttgatacattgcttacggggaatcaactgtttactatattacctgaaatagtctaaatgctaacatatctttttgataagattgtaaaatgtcactgaaggttctgattgtttttcctacatctaatttatctgtatatattttgattcatgttttaactccattagttcagtgcttattcacagaatgtgcttattcactttgcttattcactttttacctatccctaatgcttacattttaaaatcaacgtgtaaacacaattttaaaaatcaatgtgtaagctgaactttaaaatgtttaaaattcagttgggaatgaattagggataggtacaaataagaaaaaaatcaagttattaatcaaaggaaaaataaaaattatacaaagcaatgtaaccatattgtattacatggcttagctacaacttatttatatgattcaacaatgtaaaacttgaacatagatttaaaccaaaaattattgcatgaatgtagaaagagaaggtgagaggagaggagaacaggctggtaagagctaaatccttatctttt

SEQ ID NO: 131744 - DNA, 3068 bp, Homo sapiens
  Payload ID: 5713
  Gene Symbol: EZR
  Gene Name: ezrin
  Uniprot ID: P15311
  ENST ID: ENST00000337147
  CDS Start-End: 135-1895
ggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagca

SEQ ID NO: 131745 - DNA, 3096 bp, Homo sapiens
  Payload ID: 5713
  Gene Symbol: EZR
  Gene Name: ezrin
  Uniprot ID: P15311
  ENST ID: ENST00000367075
  CDS Start-End: 170-1930
ggacccgccccgccggggcttttgggagcgcgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggca

SEQ ID NO: 131746 - DNA, 2933 bp, Homo sapiens
  Payload ID: 5713
  Gene Symbol: EZR
  Gene Name: ezrin
  ENST ID: ENST00000392177
  CDS Start-End: 1-1761
atgccgtcgccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagc

SEQ ID NO: 131747 - DNA, 4835 bp, Homo sapiens
  Payload ID: 5714
  Gene Symbol: F11R
  Gene Name: F11 receptor
  Uniprot ID: Q9Y624
  ENST ID: ENST00000368026
  CDS Start-End: 276-1175
aatctgaggcagctcctgtggggaaaggcgccagtgcgccgaggcggggagtggcggcggggtaacacctggccgaggtgactcgttctgaagagcagcggttccttacaccaatcggaacgtgcaggggtggggagctggccaatcaggcgcggagggcggggccgggcggggttccacctggcggctggctctcagtcccctcgctgtagtcgcggagctgtgtctgttcccaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattacgggtgcgtgccaccatgcctggctaatttttgtgtttttagtagagacagggtttcaccatgttggtcgggctggtctcaaactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagtagacaaatgaagaaaaacaacaatttgcattaaaaaatatccaattcttta

SEQ ID NO: 131748 - DNA, 1245 bp, Homo sapiens
  Payload ID: 5714
  Gene Symbol: F11R
  Gene Name: F11 receptor
  Uniprot ID: Q9Y624
  ENST ID: ENST00000537746
  CDS Start-End: 24-776
gttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggtt

SEQ ID NO: 131749 - DNA, 4770 bp, Homo sapiens
  Payload ID: 5714
  Gene Symbol: F11R
  Gene Name: F11 receptor
  ENST ID: ENST00000621309
  CDS Start-End: 271-1110
gaggcagctcctgtggggaaaggcgccagtgcgccgaggcggggagtggcggcggggtaacacctggccgaggtgactcgttctgaagagcagcggttccttacaccaatcggaacgtgcaggggtggggagctggccaatcaggcgcggagggcggggccgggcggggttccacctggcggctggctctcagtcccctcgctgtagtcgcggagctgtgtctgttcccaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtactccttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattacgggtgcgtgccaccatgcctggctaatttttgtgtttttagtagagacagggtttcaccatgttggtcgggctggtctcaaactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagtagacaaatgaagaaaaacaacaatttgcattaaaaaatatccaattcttta

SEQ ID NO: 131750 - DNA, 1878 bp, Homo sapiens
  Payload ID: 5715
  Gene Symbol: FIP1L1
  Gene Name: factor interacting with PAPOLA and CPSF1
  Uniprot ID: Q6UN15
  ENST ID: ENST00000306932
  CDS Start-End: 144-1706
gccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaa

SEQ ID NO: 131751 - DNA, 2198 bp, Homo sapiens
  Payload ID: 5715
  Gene Symbol: FIP1L1
  Gene Name: factor interacting with PAPOLA and CPSF1
  Uniprot ID: Q6UN15
  ENST ID: ENST00000337488
  CDS Start-End: 195-1979
atgcgcagacggacctgcgctggaggcttcatctttgccgccgctgccgtcgccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgacttta

SEQ ID NO: 131752 - DNA, 2180 bp, Homo sapiens
  Payload ID: 5715
  Gene Symbol: FIP1L1
  Gene Name: factor interacting with PAPOLA and CPSF1
  Uniprot ID: Q6UN15
  ENST ID: ENST00000358575
  CDS Start-End: 195-1961
atgcgcagacggacctgcgctggaggcttcatctttgccgccgctgccgtcgccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgacttta

SEQ ID NO: 131753 - DNA, 1465 bp, Homo sapiens
  Payload ID: 5715
  Gene Symbol: FIP1L1
  Gene Name: factor interacting with PAPOLA and CPSF1
  ENST ID: ENST00000514543
  CDS Start-End: 1-79
tgctaatcctccatctggaattgaagatgaaactgctgaaaatggtgtaccaaaaccgggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaa

SEQ ID NO: 131754 - DNA, 2177 bp, Homo sapiens
  Payload ID: 5715
  Gene Symbol: FIP1L1
  Gene Name: factor interacting with PAPOLA and CPSF1
  ENST ID: ENST00000504094
  CDS Start-End: 1-765
tttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacaggtttgttggcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaagaaaggaatgtgaatgagtcacttaacagggaatctaaagagctgtgttagctgtgtacatacacagattatctgagaaaaggtcaagggttccacttgggccacagtttttttgttaatcaaacaccactctcttaagaggctgcatcacaaaaggcaacaaagggcccctctaaggcttgagattaaaactagtctttatcattactgctgtgacactcttgcttagtatattaagagactcatacatttttgatatcacaactttttgatggcttttcaatattctaaatttgggttcctggtgaaaccaaatggggtacactttcatatccaaattaataaaacctataaggcatctgggtggcctctatgaaataaattaattaattacccatagtgtagtttctaggaggcatgtgtacacacactcttcattgtggcacaaatttaaatcgcctcatgaccatgtctgtgagccagggtcaagctggtttggccttcttgatgcattttccaaggcccactggtggagcagcatgagtttttatacagttactaacgattgtggaaaaaaagagctttagccatttcttactaaaaacaaaacaagtttataattaattctctgagcgagcatttttagggataagcctaggaggtattcatcggtgatggtaacaaataacatggtatttgaaagaataaattactaggatcttttaaatagtgataatacaaaagtaatcttaattagtatcacatactaaaagacaactataacttctgaaaaatatttattcttgtttgatgaaagcaacgtttctcagcaatgcattttaaaaaatattttagctgtaaattaaaaatggccataatgtacccttggcagacttcagcatataccaaattttaaatttaaatcagcttgaattcagtggggtatacaaatcattttagttgttttagggctttttattgaatagaaaaaatataaacaatgttgtagagtaatgagaaatcctccacactgaaaaaaaactagtagttttaatttttttggaatcatattttctgaggtgtaactggctttcattagatgatcatacttttcctgacatttttacaatgtattctttctttaaatataaaaactgacaagataaatatagtgtttcaacttctt

SEQ ID NO: 131755 - DNA, 1335 bp, Homo sapiens
  Payload ID: 5715
  Gene Symbol: FIP1L1
  Gene Name: factor interacting with PAPOLA and CPSF1
  Uniprot ID: Q6UN15
  ENST ID: ENST00000507922
  CDS Start-End: 169-1305
cttcatctttgccgccgctgccgtcgccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggtaaatagtaaataagacatttgactttgaaagaaaaa

SEQ ID NO: 131756 - DNA, 1970 bp, Homo sapiens
  Payload ID: 5716
  Gene Symbol: FOXRED1
  Gene Name: FAD-dependent oxidoreductase domain containing 1
  Uniprot ID: Q96CU9
  ENST ID: ENST00000263578
  CDS Start-End: 75-1535
gcgcggagcagtgacggctgcgataatagcgaggcagcagtgcagctttcagagggtccgggctcagaggggttatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactcct

SEQ ID NO: 131757 - DNA, 1825 bp, Homo sapiens
  Payload ID: 5716
  Gene Symbol: FOXRED1
  Gene Name: FAD-dependent oxidoreductase domain containing 1
  Uniprot ID: Q96CU9
  ENST ID: ENST00000532125
  CDS Start-End: 165-1583
gattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaaggggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccacca

SEQ ID NO: 131758 - DNA, 1427 bp, Homo sapiens
  Payload ID: 5716
  Gene Symbol: FOXRED1
  Gene Name: FAD-dependent oxidoreductase domain containing 1
  ENST ID: ENST00000525770
  CDS Start-End: 37-183
agtgcagctttcagagggtccgggctcagaggggttatgattcggagggttctgccgcacggcatgggccggggcctcttgacccggaggccaggcacgcgcagaggaggcttttctctggtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggct

SEQ ID NO: 131759 - DNA, 1760 bp, Homo sapiens
  Payload ID: 5716
  Gene Symbol: FOXRED1
  Gene Name: FAD-dependent oxidoreductase domain containing 1
  ENST ID: ENST00000527004
  CDS Start-End: 18-575
ccgggctcagaggggttatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaattacctggccgtagtcgatgctcctcccctggacctccggttcaacccctcgggctacctcttgctggcttcagaaaaggatgctgcagccatggagagcaacgtgaaagtgcagagggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtt

SEQ ID NO: 131760 - DNA, 3933 bp, Homo sapiens
  Payload ID: 5717
  Gene Symbol: FOXRED2
  Gene Name: FAD-dependent oxidoreductase domain containing 2
  Uniprot ID: Q8IWF2
  ENST ID: ENST00000216187
  CDS Start-End: 113-2167
ggagcggctgggaggttcgcgcgtttctcagggttcggtcggaggcggggaggccggagctgcgggcgtagggacctggcggctcctgaagcgcacgcgggcgggcggcaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccaacaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaatgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcagaattccaaggacaatcccagcactctgggaggcccaggcaggtggatcacctgaggtcaggagtttgagaccagcctgaccaacatggagaaaccctatctctactaaaaatacaaaactagccaggcgtggtagcacatgtctataatcccagctactggagaggctgaggcaggagaatcacttaaacccgggaggcagaggttgcagtgagccgagattgcgccattgcactccagcctaggtaacaagagggaaactccatctcaaaaaataagttaattaaattaaattaaaataaaacatgcgctgggtacagttgcttacacctgtaatcccagcactttgggaggccaaagtgggccgatcacctgagctcaggaattcgagaccagcctggccaacatagcaaaaccttgtctctactaacggtaaaaaaaattagctgggcatggtggagcatgcctgtcatcccagctacttgggaagctgaggcaggagaattgcttgaacctgggaggtggaggttgcagtgagcagagaccgagccactgtactccagcctaggtgacaaagcaagacccacagtaaagcccccacaccccatctcaaaaaaataaaaaat

SEQ ID NO: 131761 - DNA, 2184 bp, Homo sapiens
  Payload ID: 5717
  Gene Symbol: FOXRED2
  Gene Name: FAD-dependent oxidoreductase domain containing 2
  Uniprot ID: Q8IWF2
  ENST ID: ENST00000397223
  CDS Start-End: 109-2163
tgacccagattgcagtgagagttcccgcaggccccgcctctttctgggcctcgtgtctcccagccgccgggccgggtgcgaggccttacccctctgatctgctgcaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccaacaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgg

SEQ ID NO: 131762 - DNA, 4967 bp, Homo sapiens
  Payload ID: 5717
  Gene Symbol: FOXRED2
  Gene Name: FAD-dependent oxidoreductase domain containing 2
  Uniprot ID: Q8IWF2
  ENST ID: ENST00000397224
  CDS Start-End: 95-2149
attggtccgggcgcgaggggcggagccgccgcggagcaagcgagccaagcgcggcctcattagaccacgggttgcagccggagcggctgggaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccaacaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaatgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcagaattccaaggacaatcccagcactctgggaggcccaggcaggtggatcacctgaggtcaggagtttgagaccagcctgaccaacatggagaaaccctatctctactaaaaatacaaaactagccaggcgtggtagcacatgtctataatcccagctactggagaggctgaggcaggagaatcacttaaacccgggaggcagaggttgcagtgagccgagattgcgccattgcactccagcctaggtaacaagagggaaactccatctcaaaaaataagttaattaaattaaattaaaataaaacatgcgctgggtacagttgcttacacctgtaatcccagcactttgggaggccaaagtgggccgatcacctgagctcaggaattcgagaccagcctggccaacatagcaaaaccttgtctctactaacggtaaaaaaaattagctgggcatggtggagcatgcctgtcatcccagctacttgggaagctgaggcaggagaattgcttgaacctgggaggtggaggttgcagtgagcagagaccgagccactgtactccagcctaggtgacaaagcaagacccacagtaaagcccccacaccccatctcaaaaaaataaaaaataaaaaagaacaaagtatgctacaacaaaagtgaaaagagaaaaagaattccaagaacccgggctttctggatccaaagctctttcatggggacgtcctcttcccctcttggcttggtccagactttttctttttctttttttttttttttgcaatggatttcgctcttgtcacccaggctggagtgcaatggcacgatgtcggctcactgcaacttctgcctcccgggtctaaacaattctcttccctcaacctcccaagtagctgggattacaagcgcctgccaccacgcccagctaatttttgtatttttagtagagacagggtttcaccacattggccaggctggtctcgaactcctgacctcaggtgatccacctgtcttggcctcctaaagtgttgggattacaggcatgagccaccacgctcggcccagtccagactttttaactacctggccccactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaa

SEQ ID NO: 131763 - DNA, 567 bp, Homo sapiens
  Payload ID: 5717
  Gene Symbol: FOXRED2
  Gene Name: FAD-dependent oxidoreductase domain containing 2
  ENST ID: ENST00000423980
  CDS Start-End: 309-567
attagaccacgggttgcagccggagcggctgggagggtggaggttactacaatcataagcggggagccggtgcccctgaggaaggagaccctgagggagataagatggaggggctcgggattccggggagccccaagtcccagcttgaaacggtggagtccgggcaaatgagctctgaggacggcttctgggcctggccgtgacccagattgcagtgagagttcccgcaggccccgcctctttctgggcctcgtgtctcccagccgccgggccgggtgcgaggccttacccctctgatctgctgcaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgg

SEQ ID NO: 131764 - DNA, 11508 bp, Homo sapiens
  Payload ID: 5718
  Gene Symbol: FAXC
  Gene Name: failed axon connections homolog
  Uniprot ID: Q5TGI0
  ENST ID: ENST00000389677
  CDS Start-End: 284-1513
cacaaagagcggggcggagaggcagctgcggggggagccggcggccgctgctgccgcccagggctctggggccccgccggccaggcccgccgtccgcggccagtgcccttcctcctcctcctcctctgccgccgcctcctcagtcgccgccgcctcctcagtcgccgccgcccgcgccgcccgcgccctccgcgcgcctctgagcccgcgccgggccgcgccggccccttcccatgcgggcggcgcgggccctgggaggggcgcccggagccagccgcgcagcatgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactggacattagcttattgccagtgggtggacaatctcaatgagacccggaagatgctctctcttagtggtggtggtcccttcagcaacctgctgaggtgggttgtgtgccacataacgaaaggaattgtgaaacgcgagatgcacggccacggcattggccgcttctccgaggaagagatttacatgctgatggagaaggacatgcggtctttagcagggcttttgggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaagcactgtgctaggtgctaatcagtatacattttattctaagccctgccagtgactagctgtgtgattttgagcaaatctcttattaactattgggtgcctcatttctcccacctgtaaagtggggatgacaatactctccacctacctacctcacaggggtgttgtggggattcatgtggtaacattcgtacggcgctttaaacctcttagaagtggtgcgacataaacacagcattttattctttattgcacttcatgcatgtgaagatttgagggcaaaggaattccatatccaggcaaccaccaccacagtcacctgcaaaagctgagcagatgaaatacacacaaaggtacacttaggactttgtcatgattcctttctgtaatcttggctgaatcaaaatcttttgttcaaagaacattggaaatgtttttacaaattatcgacagctacaaacagtcttcaattctaccatgtatttgcagaaaagtggttctttcattgcctgaactcaccctggcatgttctgtgttgactccagagtgttacgttgcctatgtttgatttatttgagaagaataaatctcaggtatatggcaggtttcatagagttgaagggaaagtatttcattgatttttataagcagaagcctgccaacttgtaatgtctttttgaaaacaaaccttgcaaagatgtattgaaaagatgaagtagcaagaggatacttgtatcaaagcactctgtgcagtgttagactatatgcagttttattaatgcaacttttctggtgttttcagccactgcccagtgagaggagagcaatgctgagaacaagtcttaatgtttttgctgtctcatccccgttctctctctctttccctatagtattcgatgaactgttggcttacccatatttgtgaaggcaccctatttctaaagatgaagttgttgttgttgttgttgttttgacttaggacattttccagggaaatatggggcagagatcctgggtgatggctgtgagatttgggctaggagagccaagatttacaattgcaaacaaaactgctttgcttctgaccaacataaggattgctcattatggggttaaagaggcacttcttaaaatacagcaacttctgagaaatccatgcactttacttgaaaaaaaaaaaacctctttttgaatatagcatttgcaaaacaatcttaaaagactgctgtagattcacaaagaggtaaagggaggagagtttttcagactgcttaccacttaagcaattgtgtagggcatatgtaactgggaatacgtgctgagataccctaagttagaaattcttattccatgggaaacttagttgttaatatcttattaaaaccattcttatttaaagggactgtttgatgcctaataagaatgtggtggagaagatatgaatggataagcctgtttgaggctgcagcatcatttgggaggactgtttgcctcccctctctctagcaagtgtgttttaaggccaactggtggcatttctgtgtgactagggagactcctggactgaaaatatgaatataatgaacaggtggactgcagacctgtctccacaaagcatgggttgtccttttcccaccacattttagtagaaaagaaatgtatttgaatttttttctatgaacaatctatcttactgtacagtaccaagtgtgatgtattttctctcaaaggatgattaagttatgagaatgtagattaatatatgtttttaattttatattacttggaatacaagtatgtggagaaccaactttgaaaatgaagttgtaaaataagtcattccatccaggtacctcttacaggggcatgaatggacattgctatctggagtcttgggcaattgcctgacagcatataactgggcatcaacattttgtaggtgttaatttgatttagagccctagaatatgcccctgctttactttcccaaggcgggttatgcaaacaaaataaccaagacaaagtcaccatagtgtgagtctttatccggaaggatttaattttatgtgcttcattcttaagctacccagatttgaaatgttctccaatttcatgaacaggtgctaattataggaaaaaactataagaagttaagggacattttggtcatctggcttcttgttcaagttctgtgtttcctttttgctggaaggtaacttgaagtatgtgatctttaatgttaacagatgcttttggttggacaacagacccataggctattcgttctttttttcctgtcattgtaaaagtaaatcaagctcttgcatccacctctctttgcccatctgtacccccactcaacaagattaatgagcagaatcattgagctttactctccatcagaacagatataaggacaatctatatttatgcaatgatgaactatattgtcagcatttaccaatttgttgttgttacataatgaattgtagaaagtgacactaccaaggctgtgggctacccaggagactaatcacggacctggaacaacttggacttgaatcagactgcagtctactcctcaagtgagccctgcccatgtatactgtggtgttagggtatatttttgtgaaatagctaaggttcaaggaacagacatactaaggattttggccttgtgggtcttgcttagatttgtttgagagataatgtagagtcatagaaatgtatagctgtgctaaaaattagctgtagaaagcaccttattggctcagtgtcacatacatacttatttgaagggcaggaccaaaaactgaggtcaatatggttctttccattacaccacgttgcccttgatggtttctttctattataccaccttgcccttgatggttctttccattataccactgtggctttgttgtcttataaaatgcatgttacctgagaagtcaccctgtgttcagacaaccagcacatctccagccattccctggttggaatcctacttcgcttttgtccatgtcctgtcagcctggtcaagaccaatacaagagacctctcatcagtgcagggtattgctagactctgaagaatagcaagatggattcccaaatcaccaagactcctcatacttccttatgtatcttttaaagaacccatgtccattccctcacttgctgaatatttacagagcacctaccctgtgcctggccctgggatctacactggttgtagagtggcaaatagaacagcatagaactctgatttcagggcatcctcttttgcctagacttctctagcctcttttacgtacttggccatttccctgttccattccatccactacaaatggattaatctttctaaaaagctctttggccctgatggggtgtggcattgcctcagggtgaggggctactccttagggtctggtgttttcacctttgttcaccttgtctccatagctcctccatgggagccatccagtgcagccaggttgatccatttgccattgcctaaaaaagcctcatgtggcccacctctgtgcctctgctcatgccagtccttctcctgaaatgttctattctctgctccactggcccaagtcatgcccatctctcaaggtctgacttcgtcagcttcacatgaaggcttcccagctgattataatctcttcctttgaaaatgaagcactcatcacttccttccctgaaggttgcatgggaaagatgctcagagagtgagtcacataccattaaatagtgaattttcactttttgtttgtcaggaactccactgataatccaacgaaagttctataccctattcccagaaaaacacatatatgcaaatacataaaatgttacatataaattcaggaaatttagagacctcctgaaattatccatggtttcctcagggggttaatggaccccagttaaagagtcttgttcccaagagtctttaaatgttatcattgtgtttgttcttgtttttaacacagccagagagaagaaaaattagtacaggctatgcaagcaaaagtaatctctattatccatgttcagtatgtcttgagtgacagaaaagaagaaagaagtgctcttaggttatttgagaaaattttgttttagaggtttggaattttgaaagtcataggattttgttgttgtccttgtcatttatcttttaaccacccccaaaattgatttatcaaaatgagttcagggccaagtgcgcttcctttcagccctgaaacccaccgcttctgcatggatagggcaaccagcctgggctgaaggtgggagagaagaggctggatttttcttccttaaagaagaaaggtctgcacaatcaggttttcctgtattcatttattcattcattcatagaacaattgttgagtgtattttcaataaaaggttggtggcttttgttgatagggaacaactcaggttattcttctttctttcttttagggttttttttttttttaaacagagtatgttattttattgttcctgactatgacccaggatcctttgttctcctttatatgcagtgctatttaagtcaaactagaactgataaaagtacactcaatgacgaatacttcccaggctaaatgctgggctctgggaacccatctttaacaggtccagggatcaattgcatgtgattgtgaagtgcttgacctttattcagttgcttccagtggtctggatataacttgggaagttcaaaaggattcccttgttgggtgaggagggacgggcctcttacctgtaagactcttgctactgtcaggcgtggatgcgaacatctgtggcatgttttcctcatctgaattccttacccagaaactcagatttttggtccctgactttcaagaatatcttaaggatatttaagtttccttaatctttgagatgagactgctggaaccagcaacgttagccttgccagttagagatgattacagagggcactgaagcatagatttaaaaaaaaggggttcagctgttttggagctgacagggtgacctcctcaaccattctgctttcgccgaagcaaggaacttgtccccagacctagaccctctaaaactcctgctattggctggaccatgacaaactaggatgctcaaatttcataaggatgattgccttaaattgtaaaattggtagacaaataaaggggaccattgcaataataaaacgaataacctacagatatggtctagcagcaccaaactgaccatttcagtaggaaaacaagtaatctggagtaaaagatggatacggtactttggtgttctgtacacaataattttagcaaagaatttaatggccatcatgcatttttgaaacaatccactaaccataaagcaatatatgtgtatcataatcagttaactttataaaaagttgtgctactaaatgtgactaattcacctcccaccccccattggcatgcatttatttttatttatttgtttttatttgtggctctggaatagagtaactttcacttattagtaatgcttaagcttttttccttatttaataccttttttgtttttagttaccccatggcttctaaaaaaataagatccaacttctgaattgccatgttagttaatggtggctaaacagatagcaaagggaatataatataattgttcattgagggctaaaaaagaggaatgctctgaatatttactgtcttcctcctctttaaaaaataatcaatgactttcctcttccattgttcagaatcagaaatgttctttcgtatttgcttctcttctacaagagattatatttggcttattaaaatataaaccatgtccaaatgattgtatttttatctttaacaaattatgcctgggatttgttttttacagaaataaggctaaaggcttctgcttcagtaggggtgacatgtttactcctgtaaaatgattttaatgttactcctgtcaaaatgattttattgcaagtaataagtcttgtgggatcagaacaagcttattgtaaacacatgtttttttcccagtgatctacatcatgccaaatgtctgacaactcaaatgttgatgacagcgatggtttttccatggtgaagtttggaaaactgagggtctgagtccctcatttggtggtattagaatttaactgagtaggaggagagaagaaaacagtaacaaatgtcaaaatttcaagcaaccatgtggtatggctgtggtagagatgtatcaggcaattgaaagttttctaggtggtgccatcttgctaaaataataaaaagtacaggtttataaatcaaaaacaagtgcaatctatgtagggaaggattgtctatggatatacaagtggccagtgcaggaagtgaagtaacatttatctttatcttaatttctatgctcatgtcccccattccccttctgaagccaggcctgggaccttagatagcagcttagagggtctggccctgatacatttactcctttaattttggaatttccttctagtctctcaagagtgtttgtggcatatatttttcattttataaatataaaattgtacaaagtaatgtacattttgttttagagaagtcttttaaatgtttgcagacagcccagatcgtccatccctatttaggcagtggtctccaaacgtttatgtttattcaccctattagtaaaactttctgagcatgcccctccatgtatttatttatgatatatatgtatatatgtatacactgctatatatgtatatactgttttactgatgtaaacattaaaaaccatagcaaacatagacattttaaaagtatattttctggtcctcaatggagtttagagaatgggacaaggagtctttaggcgtagcacccagatgcctgtaattgattagagaatgtgtatataccatttgtggcaaagcagatataaaacaggcatggacgcatgattttaggtcaaggtatttaattatttttacttaaaataggcatttttggttgggaaagagaaggatgaacaatttgatgtcacctttaagactgatgtttttaattctgcttttgggaccacttgatctagaatgccttgaaaattccagaaagatttaacaacacactgaggtaagcaaaacaagaaaagaaagtaggggtgaggtgatacccagataatgcaaatgcaggatgtattgtctgtgaatttcagcatcaatctgaaaaacatgttttgataatgcctgataattcatcatctcactgattacatgtctttttttctatttgtttataatcttgtgtcttcaaatgtgtggaagatgtgcagacttatttttaggtatctgagataggaagggccaatgttggcataatttgaacccacatttcggggctaatgggcggacaccacctggaaacacttacctgcaccctctgttttgcaatcacaatgattagcatcttgctgaatgatgaccccaatgtgaagatggcatttcagtgtttatttctggatctatgagttactttagcagagttattagtagtttataaagccatatttaaacttgtacacttgattgtaagatagatttgaattgtgcactatgttgactactgtatataaatgtggaaattctgtatatttggtcttaatgctatatgtatttgatgtgtaaatgataactaatggatatgaaatagttttctgtgaatgtctttcttccaatttacttctcttttgcaaatttgaatgtttaaacttcaggctcatggggaaaatctgaaatgtttgcatctaatatactgttaagtggtggtctcttagatgactgggagagtattttagttgtaaggctcttgtataattaaaacagaggtaatgaattttttaggcatataactttgatagaatttcaagtgagtggcttttaagaagaaaaacagatctctggaatatgctgtcccatcctctcctgcttttatttcatgcccagtgtgcctcagagtgttacgaagtgtgagaaccactggtagagagaagacaaggaggagagggagagctgggagcacatgttgagacctttactatggctaggccttataatagaccaatttccccttgtataaatattgtctcaattaggcagggtgcagtggctcatgcctgtaatcccaggactttgggaggccaaggtgggcagatcacctgaggttgggagtttgagaccagcctgaccaacatggagaaaccctgtctctactaaaaatacaaaattagccgggcatggtggtgcatgcctgtaatcccagctacttgggaggctgaggcaggagaatcgcttgaacccaggaggtggaggctgcagtgagctgactttgtgccattgactccagcctgggcaacaagagcaaaactccatctcaaacacacacacacacacacacacacacacacacacacacacacacatatagtctcaattagttttcatacctcttcaataaagtaattattgttcccaaattacagatgaagaaagacgtttgggatgataaactggcatatggtaatatggccatgatatgctcaagtctttagggtcagagattcacagcaagattttggaaattcaaatcttactatgaagtgattcacacatgtgtatggtaatgaaccttaaaggatagctgggcctataggcatgtcaagatctatagagacatgcaggatgtttcaaattctatcttaaaatttgaccaaatctttggtcaaataataatactgttactcaaatattagctttttaccatttagagcaaattacaatcaggtaacattcaaaattctaaccctcccttcccaacatgggaatatctattaagtaggaaatgagagaaccccctaatttcccatttcagtgataatactgattgagtatctcttatctgaagtgcttgggaccagaagtgttttggatctgggtttttctcagattttgaaatatttgcattataccagttgagtatcccaaaatcaaaactggaaatctgaaatgatccaatgtccgtttcctttgagtgtcatgttagtgctcaaaaagttttggattttggagcgtttcagattttggatttttggatttgggatgctcgacctgtagtttggttttcatctttttagactccatttctcttgacctataaatcctatcagccctgtttattaacatagaccctagtcagaaatactttgaaatagatctacatctacttcaacgtcagttggttccacacccttctagaacttgtgtggggtcctggacttcccgtctgtcctgttagggaagctttgctgtcctagctttcaggactcatcagagggaagagggtcatttacctttccaatgtgctgtgatctcagagtcgttaaaatacatgttttgctgcc

SEQ ID NO: 131765 - DNA, 941 bp, Homo sapiens
  Payload ID: 5718
  Gene Symbol: FAXC
  Gene Name: failed axon connections homolog
  Uniprot ID: Q5TGI0
  ENST ID: ENST00000538471
  CDS Start-End: 55-444
ggaaacttatttaaggatggctgacttaccgtatcaggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatatt

SEQ ID NO: 131766 - DNA, 3029 bp, Homo sapiens
  Payload ID: 5719
  Gene Symbol: FAM47E-STBD1
  Gene Name: FAM47E-STBD1 readthrough
  ENST ID: ENST00000515604
  CDS Start-End: 27-1082
acggtggccgcgaagctagggccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctaatgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaatttt

SEQ ID NO: 131767 - DNA, 2532 bp, Homo sapiens
  Payload ID: 5719
  Gene Symbol: FAM47E-STBD1
  Gene Name: FAM47E-STBD1 readthrough
  ENST ID: ENST00000514140
  CDS Start-End: 1-576
aaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacaggtctgctggagtttgctggaggtccactccagaccctatttgcctgggtatcaccagtggagactgcagaacagcaaagattgctgcctgctccttcttctggaagcttcatcctggaggggccccagcctgatgccagccagagctctcctgtatgagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctaatgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttc

SEQ ID NO: 131768 - DNA, 1465 bp, Homo sapiens
  Payload ID: 5719
  Gene Symbol: FAM47E-STBD1
  Gene Name: FAM47E-STBD1 readthrough
  ENST ID: ENST00000514365
  CDS Start-End: 16-177
gaagctagggccaccatggcggaccgcaggcggcggctccggccggggacgttggccccggtgcgcgagggcgtgaactgcaggtccagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctaatgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgccca

SEQ ID NO: 131769 - DNA, 1484 bp, Homo sapiens
  Payload ID: 5719
  Gene Symbol: FAM47E-STBD1
  Gene Name: FAM47E-STBD1 readthrough
  ENST ID: ENST00000509377
  CDS Start-End: 15-176
aagctagggccaccatggcggaccgcaggcggcggctccggccggggacgttggccccggtgcgcgagggcgtgaactgcaggtccagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaag

SEQ ID NO: 131770 - DNA, 2148 bp, Homo sapiens
  Payload ID: 5720
  Gene Symbol: FAM101A
  Gene Name: family with sequence similarity 101, member A
  Uniprot ID: Q6ZTI6
  ENST ID: ENST00000324038
  CDS Start-End: 244-651
acactcagtctctgattttatccctgccctggcttaattaagtgctctgaagacataaataggttttttgtttactcaagcttgggagaagctggcagaaaaggccttttcagctaaaagctccttacagccggaaggtgtgaagcggcaagtttccagccgggaagaagcctctcagccgtaggcgtctttgcccggagctgtgagcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaaccc

SEQ ID NO: 131771 - DNA, 652 bp, Homo sapiens
  Payload ID: 5720
  Gene Symbol: FAM101A
  Gene Name: family with sequence similarity 101, member A
  Uniprot ID: Q6ZTI6
  ENST ID: ENST00000338359
  CDS Start-End: 147-554
cagaccaagccagggccagagggtgtcaggtggtcctgtgtgcccagcagggagctgaggccactgcaacaaggggctgcataaccccgtgtccctggctctccccacagcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcagga

SEQ ID NO: 131772 - DNA, 2385 bp, Homo sapiens
  Payload ID: 5720
  Gene Symbol: FAM101A
  Gene Name: family with sequence similarity 101, member A
  Uniprot ID: Q6ZTI6
  ENST ID: ENST00000389727
  CDS Start-End: 481-888
gtgcggagcgcgcgcgcgcgcggctcggaggcgcacctgtgaggtgtccctgaggagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccaggccgcacttggtgagagtcttcacggaccacagtgttgcacgaggtgattgtgtttgcagaggtttttttgtccttgaagagcacttagggctggagagcaagacacatgctgacgagcagaagctgacaggcttgctgccatgtgggaaagtccttggacgagttgtctgcttgcggagaggtgtctgcggctcagcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaaccc

SEQ ID NO: 131773 - DNA, 2354 bp, Homo sapiens
  Payload ID: 5720
  Gene Symbol: FAM101A
  Gene Name: family with sequence similarity 101, member A
  Uniprot ID: Q6ZTI6
  ENST ID: ENST00000546355
  CDS Start-End: 205-855
ggagcgcggcccacggcggcgagcaggctgcaggcccgcggggatccggggcgcggggggcgccgggcctgatcgccgcctctcgcggtgcccgcaggtccccgggcgcgcagctctcgccccgccgccgcctgccccgggccccggagcgcggtggagaagcccccggaggagcggggggcccgcgccccgcgccccccagacatggtgggccacctgcatctgcagggcatggaggacagcctgaaggagcagggccgggagggcttgctggacagccccgactccgggctgccccccagccccagccccagcccgcccttctactccctggcgcccggcatcctcgacgcgcgcgcggggggcgccggcgcctcctcggagcccccgggacccagcgaggccagagcgcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaacccaa

SEQ ID NO: 131774 - DNA, 3621 bp, Homo sapiens
  Payload ID: 5721
  Gene Symbol: FAM101B
  Gene Name: family with sequence similarity 101, member B
  Uniprot ID: Q8N5W9
  ENST ID: ENST00000329099
  CDS Start-End: 1-435
agtccagcgtctctccccctggctcccggctgtgcgctgaggctttgtcccctgtcctttggcgaaggagtggagtttgaccccttaccaccaaaggaagtaaggtacacctccttggtcaagtacgactccgagaggcacttcatcgacgacgtgcagctgcccctgggcctggcggtggcctcctgcagccagacggtcacctgtgtccccaatggcacgtggcgcaactacaaggccgaggtgcgcttcgagccacgccacaggcccacccgcttcctcagtaccaccatcgtgtaccccaagtaccccaaggccgtctacaccaccaccctggattacaactgccgcaagacgctgaggaggtttctgtccagcgtggagctcgaagccgcggagctcccgggcagcgacgacctctctgatgaatgctgacccagcaggctgggctggggtcggaccggctctcccgctgtcctgcccccgactgccctggccaagctgggcgaccttacccttcacgtcattccagccccagaggagtctaacctagagatacctccaagcgcggccgggggaagagaaaaaaaagaaaaaatcactgcatctcataattattgagatctttgtgttgtaattttcaagctgtttttagagggaatatatgtcctggtttgctgctgtgttgtttccccaaagtctcaatcagatgaggcaacaaaaagaccaccagaattgcaggaaagcagcagcagtctgggatagggaggggggaggagagctctccctccgtggtcagtttgtcagaagaaaagcatggaaaaagtgagatttaagaaatctcagccacgggtgtcttcactgcacaaaagtggtgctaattcagtaaacagtgacacctgtgtgggttcaatctgtggagagttgagttccattcctttgtttttaaatttccacctccatttgtgtttcctattaacctaaactcttgtaattctctaaatcttttttcatgatataaaaaaaaaagaaaatcccaaaccacaatttaagatgccttttttttttaaaaaaaaaggttctccgtgttgccacctgctccgggaaggccaggccgatgggcggccaggtttgggagcagcggcttcggctccgattgcttcctgacggtcagttccaagcacaggctctgagaaacgcctcgaacccttggtatctggtgaccgtctccgcaggcttccgtgagtctccgataggtgttttgggcttttggaatactttcagaatactttcccattttttcataaggcaaaacggagtggacggcctttttttgagagaaacagcattctaagagtgtgcttggaaaacacactttttgggagtccacgtggggagtggacactcaggacaggaagcggtggccctaagacctgcggccacccggaggaggcagacgcaggcgatgacctggttcatcatgagaggagctagagttgactcagtcttaggatctcgatggcgtcagaattgcagagggtttctgccagtgccttaggtctaattcagaaagcaaggaaggctgggcacggtggctggcgcctgtagtctcagctacttggaaactgaggcaggaggatctcttgagcccaagaattcgagaccggtctggcaacatagtgagcctccatctctaaaaaaaagtggcaaagctgaggaaatctgtgcccccatcccccgacaccagacaagctaaggtgcattcagagtagggaacgatgtcaaaacctggccgccgtggtggcgcgcattcctctcacaccaccgtacggaggcaggtgacagtcaactgaaatgtccccaaggaccgtgtgaattcggctggcgtggcccagcagcggggtggaccagggtgcggtggcttcagacctgcctcccgccaccccgtcctcccctaaccccttcttgggacctcctgccaatccctgtggtgtttgagtaaagaaagtggctgatggttttacttttttcttccaatattggaaagaacaaactagatattccccttgaacacatccaaattatttccagtgcctgagggttaccgagcactgtaagctcagctcggctgtagctccgggtttctgccgatggcctccatctgcgccgaaagctgaactgagccccgcggtgccccggagccacagcagcaggtgcagcgacaatcgccgtcgtgcgcagtcgctggagtcctggagagccacgctgtcctctgcagacaacagcatcagtccgctgtgccccaatgcatcgacgccctgtggacggggcctgcagtccacccgtggtctgagcttgccgggctgaagctcggctgggacccagggaggggccaccctgggacccacagtctcctcagtcacgtgcagagcaaaaaatgcttcctgtgtttggaagagcaagtgacgcagcatttattgataaaaatggatttttctgtctgatttcatgctgtggtcgtttaagtggtcaatgtcttttttttttttttttttgacatggagtctcgctctgttgcccaggctgagtggaatggcgccaactcagctcactgcaaccttcacctcccaggctcaagcgactctcctgcctcagcctcctgagcagctgggattacaggtgcccaccaccacgcccagctaatttttgtatttttagtagagacggggtttcaccatgttggccaggctggtctcgaacacctgaccttgtgatccacccgcctcggcctcccaataatttgtaagttatgttagcgggatcctcaaggccttgctttgccccgtggagacgcttgctcggatgagctcaggaaacagtaccggctgcgtggcaggtctgggtgttgtgtgcgaggacgtggcctttgaacaccgctgtgttctcagaggtccttaggagatatttttttttgtcttagggggactgtgttaagttcagacaaatcatgctgggtgtgtagagagtgtgaaatacgtcagtgaagtaagtagcagtgagcgattgtgaatgtgtaatgtaaatggaaaaccgggttttaccgtgttaagttattcactagggagccagtcgtagttctttgtaatcctctttcttccaaacctgctttgctgaaagttgcagaaaaggaagtgtgtggagagaaacagaacccttcagggtgggtcagaggacgccatccacagtggattcgtgttcgtttgcaggtggaagcagtgatttttaggacccactgattaaaaacaaacattcccaagtgtctctgagagatgctgtttatttgttaattaaaaagcttttttctctgtcttttaaattatggctttcatgtaataaggatatttttagtgaaaaattgttttcctttcaaattacagaccttttaaaaaaacttaatttgagcgagtaccttttcatttgacacttttcctgtttctaaccttaggaaaccagaatagcgtttggcagacacgacgttttcagtttacctttgacacctgccccactccattttgctttgtgatgtcttcatttaacaataaattatctgaaaaaacaaaa

SEQ ID NO: 131775 - DNA, 3352 bp, Homo sapiens
  Payload ID: 5722
  Gene Symbol: FAM102A
  Gene Name: family with sequence similarity 102, member A
  Uniprot ID: Q5T9C2
  ENST ID: ENST00000373084
  CDS Start-End: 313-1041
gctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatc

SEQ ID NO: 131776 - DNA, 4144 bp, Homo sapiens
  Payload ID: 5722
  Gene Symbol: FAM102A
  Gene Name: family with sequence similarity 102, member A
  Uniprot ID: Q5T9C2
  ENST ID: ENST00000373095
  CDS Start-End: 377-1531
ccgcgcggcgtgagctccccggacatcgcgtctcgggatgctgcaagccagcgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttcttt

SEQ ID NO: 131777 - DNA, 5600 bp, Homo sapiens
  Payload ID: 5723
  Gene Symbol: FAM102B
  Gene Name: family with sequence similarity 102, member B
  Uniprot ID: Q5T8I3
  ENST ID: ENST00000370035
  CDS Start-End: 341-1423
tcccgactcccagacgggcggcagcggcggcggaggcggcggcggcggcggcggcgagctgagcaccaaaagggcgctcacctccccgggcgagctgcagcacgaccgctccccgcgggcggtcggggtccgcgccgcagctgccgccgcgttccggcccaggctgccgcgagaggcggcggcagcggccccggccgcggccggcctgcggcgccccccggccgcgcccccgcgcacagctcgcggccccggccatggggctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccagggaggtggtacaagcaaactgtgttcgctggagaaagaagttctcatttatgtgcaaaatgagtgcaagtgctgccacaggcatcctagatccttgtatctacagagtatccgtgaggaaggaattaaaaggtggaaaagcttatgcaaagctgggctttgcagatctaaacctggcagagtttgctggatcaggaaataccactcgccgctgtttactggaaggctatgataccaaaaatacaagacaggataattccattcttaaagttttgatcagtatgcaactgatgtctggtgacccatgttttaaaacgcctccctccacttcaatgtctataccaattgctggtgaatctgaatctttgcaagaagatagaaaaggtggagagactctcaaagtgcatcttggaatagcagatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagcgagttgatgacaccagggtggatgcagatgacattgtagagaaaatattacaaagtcaagacttcagcctagattccagtgcggaagaagaaggactaaggctatttgtgggtcctgggggaagtacaacctttggcagtcatcatcttccaaatagggtggggtctggagcttatgaacaagttgtgatcaaacgctagaagtcaagtcggtgaaaacatttccttgtggatttaagatgtgagtagttgatgtatcaaggcattttattcaagcacttaatagaaaatgaacctcaactatcaagaggaaagccaatgctggtttcttctctggaaggacccaccgccatcctgtaccagccaccaaaggggaacatctacatggcagtctccaggcactgtgccactgtgtgccttggaagcacctggcttctgtggtcactgcacatcataatgaaaagcctgctttttctttcagaacaccccagcggagaaaacagcattatatacatcggagtatcattttaggattcaagtgtaaaaatctgtgatcaagaggctcaatagatttgggctctatggtttggtttttttagtttgagagacagtacatgaatataacttaaaccctatagattttgtcaagatagttgtaattcctgttctggaaatcttccctattacactacctacagcattgtataaagtgtgggtgttcatgctttgggaaaatgttagactacaatttaaacatgtgatgtgcttattcataattctcagtgtatcagtcataaatgaaataacaagtgcatttaagtcagagatacgtgaatggatgtaatgccgttatgcagtatatattgttaattgtcattaatattagatgagctgcagaaccacccccaagcactacataaaagactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatgttgtcttaggtactacgcataatgttaatagctgagatgttaaagaatttgaagtctaaaatataaaagatgaatatacccatattaatcctatgttaagatgctctggaaataaaggccttattcccttacacatgcgatttttgtaagataatatatacacagtatattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaagttta

SEQ ID NO: 131778 - DNA, 1585 bp, Homo sapiens
  Payload ID: 5723
  Gene Symbol: FAM102B
  Gene Name: family with sequence similarity 102, member B
  Uniprot ID: Q5T8I3
  ENST ID: ENST00000405454
  CDS Start-End: 341-1408
tcccgactcccagacgggcggcagcggcggcggaggcggcggcggcggcggcggcgagctgagcaccaaaagggcgctcacctccccgggcgagctgcagcacgaccgctccccgcgggcggtcggggtccgcgccgcagctgccgccgcgttccggcccaggctgccgcgagaggcggcggcagcggccccggccgcggccggcctgcggcgccccccggccgcgcccccgcgcacagctcgcggccccggccatggggctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccagggaggtggtacaagcaaactgtgttcgctggagaaagaagttctcatttatgtgcaaaatgagtgcaagtgctgccacaggcatcctagatccttgtatctacagagtatccgtgaggaaggaattaaaaggtggaaaagcttatgcaaagctgggctttgcagatctaaacctggcagagtttgctggatcaggaaataccactcgccgctgtttactggaaggctatgataccaaaaatacaagacaggataattccattcttaaagttttgatcagtatgcaactgatgtctggtgacccatgttttaaaacgcctccctccacttcaatgtctataccaattgctggtgaatctgaatctttgcaagaagatagaaaaggtggagagactctcaaagtgcatcttggaatagcagatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagcgagttgatgacaccagggtggatgcagatgacattgtagagaaaatattacaaagtcaagacttcagcctagattccagtgcggaagaagaaggactaaggctatttgtgggtcctgggggaagtacaacctttggcagtcatcatcttccaaatagtgccctggaagctccctccttgctttgagttgtccccgcctttctggatggaaccaatgtacttcttacatatattgattaatgtctcatgtctccctaaaatgtataaaaccaagatgtgccccgaccaccctgagtacatgttgtcaggacctcctgagactgtgtcatgggagcgtgtcctcaaccttggcaaaataaactt

SEQ ID NO: 131779 - DNA, 1568 bp, Homo sapiens
  Payload ID: 5724
  Gene Symbol: FAM103A1
  Gene Name: family with sequence similarity 103, member A1
  Uniprot ID: Q9BTL3
  ENST ID: ENST00000304191
  CDS Start-End: 222-578
gtcaggtggttgtcggattttagaggaaggcgctcggttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagtttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactcccaa

SEQ ID NO: 131780 - DNA, 2798 bp, Homo sapiens
  Payload ID: 5725
  Gene Symbol: FAM104A
  Gene Name: family with sequence similarity 104, member A
  Uniprot ID: Q969W3
  ENST ID: ENST00000403627
  CDS Start-End: 62-622
ggtgcggttgggatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatacttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcatcttttacaccttctagtagctcaagctagtaaaaccttgtacttctctattgcgccgccattaaaagcagcattagtgcattttgtcattca

SEQ ID NO: 131781 - DNA, 2865 bp, Homo sapiens
  Payload ID: 5725
  Gene Symbol: FAM104A
  Gene Name: family with sequence similarity 104, member A
  Uniprot ID: Q969W3
  ENST ID: ENST00000405159
  CDS Start-End: 66-689
agtcggtgcggttgggatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagacagtacctgtaatgagaaacagtaaagaaaacagactaagaggaaacaaagcgttctgcgcgtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatacttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcatcttttacaccttctagtagctcaagctagtaaaaccttgtacttctctattgcgccgccattaaaagcagcattagtgcattttgtcattca

SEQ ID NO: 131782 - DNA, 417 bp, Homo sapiens
  Payload ID: 5725
  Gene Symbol: FAM104A
  Gene Name: family with sequence similarity 104, member A
  ENST ID: ENST00000583024
  CDS Start-End: 15-344
acggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggattcctgggacacagagtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcct

SEQ ID NO: 131783 - DNA, 451 bp, Homo sapiens
  Payload ID: 5725
  Gene Symbol: FAM104A
  Gene Name: family with sequence similarity 104, member A
  ENST ID: ENST00000580032
  CDS Start-End: 140-430
gaataagcaggtgaatgtgaccaagaggaaaaggagaaggaatggcaacgaagaagacaaccatcttcccccccagaccaaaagaagtagcagaaaccctgtctttcaggattcctgggacacagagacagtacctgtaatgagaaacagtaaagaaaacagactaagaggaaacaaagcgttctgcgcgtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgcct

SEQ ID NO: 131784 - DNA, 422 bp, Homo sapiens
  Payload ID: 5725
  Gene Symbol: FAM104A
  Gene Name: family with sequence similarity 104, member A
  ENST ID: ENST00000579872
  CDS Start-End: 46-422
gggcaaataggcaaaggcagccactcttatatcaaatgttgtcatatggaagggagtacaattaggaaaaggagaaggaatggcaacgaagaagacaaccatcttcccccccagaccaaaagaagtagcagaaaccctgtctttcaggattcctgggacacagagacagtacctgtaatgagaaacagtaaagaaaacagactaagaggaaacaaagcgttctgcgcgtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgaggga

SEQ ID NO: 131785 - DNA, 512 bp, Homo sapiens
  Payload ID: 5725
  Gene Symbol: FAM104A
  Gene Name: family with sequence similarity 104, member A
  ENST ID: ENST00000581110
  CDS Start-End: 89-400
ctcttcccgtgggcggggttaccagtcggtgcggttgggatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccagtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccactt

SEQ ID NO: 131786 - DNA, 1067 bp, Homo sapiens
  Payload ID: 5726
  Gene Symbol: FAM104B
  Gene Name: family with sequence similarity 104, member B
  Uniprot ID: Q5XKR9
  ENST ID: ENST00000332132
  CDS Start-End: 40-390
aacttcctgcgcggttgctatggttccgagggcaggactatgggaggctgccctgtacggaaaagaagaagaaatggcagtaaagagggcaaccatcattccacccagcccaaaaggaataagagaaaccctatctttcaggattctcaagatacagaggtattttcatggagtgataatgaaaggagcagcagccgcattaatatcccagagagagcaagtggaccagaaggcaacttaaaccagattgttactgaacccgatgcaaactttccccagttcttgcatgagggattgtctaaacctgtttatgtcataaactggtttatgtcctttggtcctgaaataaaactcaatacttcacagcagggaaggaaccaagctgtttaaaactacttatctccgctatgaaggagaagtattttcaaggaatatcagaagaaagtagaaagtgagaggaggttccagctgggcttcctgggtcaagtaggggctcagaaagctgtgaaactcactcatttcctgcatgcggacttactttggtcctggatgaataatattgaagatatgtgcttaaaacattcctaacatcagaatttgcgcctgtgttttcttccccaagaaagctataaacagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagcttttttactctc

SEQ ID NO: 131787 - DNA, 1179 bp, Homo sapiens
  Payload ID: 5726
  Gene Symbol: FAM104B
  Gene Name: family with sequence similarity 104, member B
  Uniprot ID: Q5XKR9
  ENST ID: ENST00000358460
  CDS Start-End: 155-502
cggcggacccagaggaaacaggagccgacctccccgggctccgatgcgcaggcccagagcccgtcaatccttggccagccccgccctccgggctgcgtttttccggcggcgcaggaacttcctgcgcggttgctatggttccgagggcaggactatgggaggctgccctgtacggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgagggattgtctaaacctgtttatgtcataaactggtttatgtcctttggtcctgaaataaaactcaatacttcacagcagggaaggaaccaagctgtttaaaactacttatctccgctatgaaggagaagtattttcaaggaatatcagaagaaagtagaaagtgagaggaggttccagctgggcttcctgggtcaagtaggggctcagaaagctgtgaaactcactcatttcctgcatgcggacttactttggtcctggatgaataatattgaagatatgtgcttaaaacattcctaacatcagaatttgcgcctgtgttttcttccccaagaaagctataaacagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagcttttttactctc

SEQ ID NO: 131788 - DNA, 1229 bp, Homo sapiens
  Payload ID: 5726
  Gene Symbol: FAM104B
  Gene Name: family with sequence similarity 104, member B
  Uniprot ID: Q5XKR9
  ENST ID: ENST00000425133
  CDS Start-End: 40-390
aacttcctgcgcggttgctatggttccgagggcaggactatgggaggctgccctgtacggaaaagaagaagaaatggcagtaaagagggcaaccatcattccacccagcccaaaaggaataagagaaaccctatctttcaggattctcaagatacagaggtattttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttatcctctagagtgtgcacttcagacttagtaggaaacactgcacaattctgtcagataagaaatatgtaatattttgtcttaaacaaaaatttattacgttagcacattatgtgatctcataattccatctattatgtatagag

SEQ ID NO: 131789 - DNA, 1109 bp, Homo sapiens
  Payload ID: 5726
  Gene Symbol: FAM104B
  Gene Name: family with sequence similarity 104, member B
  Uniprot ID: Q5XKR9
  ENST ID: ENST00000472571
  CDS Start-End: 27-167
gttgctatggttccgagggcaggactatgggaggctgccctgtacggaaaagaagaagaaatggcagtaaagagggcaaccatcattccacccagcccaaaaggaataagagaaaccctatctttcaggattctcaagatacagaggtagcaattttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttatcctctagagtgtgcacttcagacttagtagg

SEQ ID NO: 131790 - DNA, 1170 bp, Homo sapiens
  Payload ID: 5726
  Gene Symbol: FAM104B
  Gene Name: family with sequence similarity 104, member B
  Uniprot ID: Q5XKR9
  ENST ID: ENST00000477847
  CDS Start-End: 135-473
tttccggccggtaccagtccgagctctggtccccacggtcatcacgctttgctttctcagccaagatctcggggctcagggcggaaacgcagcggatatgtattttcttccggggttggtggcgctcggctctcatgacctgcaggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttat

SEQ ID NO: 131791 - DNA, 712 bp, Homo sapiens
  Payload ID: 5726
  Gene Symbol: FAM104B
  Gene Name: family with sequence similarity 104, member B
  Uniprot ID: Q5XKR9
  ENST ID: ENST00000489298
  CDS Start-End: 222-566
tccgagctctggtccccacggtcatcacgctttgctttctcagccaagatctcggggctcagggcggaaacgcagcggatatgtattttcttccggggttggtggcgctcggctctcatgacctgcaggtgacagtgttggccggtggcgcggccctgcttgcctcgtgccccgcccttcgtgcttgaaaaaaaatcccgcgaagccttctccgaaagaacatgctggttctttggttgaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttg

SEQ ID NO: 131792 - DNA, 3597 bp, Homo sapiens
  Payload ID: 5727
  Gene Symbol: FAM105A
  Gene Name: family with sequence similarity 105, member A
  Uniprot ID: Q9NUU6
  ENST ID: ENST00000274217
  CDS Start-End: 121-1191
cccgccctccccagcccgcctcagggaagcgagcccgggcgccggcgggcggccgtcgcgtctgacagaccactgcagaccacgggccgaggcccagcgcccgtccgcagcgcggccggcatggcggcgacaaggagccccacgcgggcaagggagcgggagcggtctggcgctcccgccgcaggaagtgaccaagttcactcctggatgctagctacaagccaagccttagacactgtctggagaatggcaaaaggctttgtgatgttggcagtttcatttctggtggctgccatctgctacttccggaggctacatttatattcagggcacaagctgaaatggtggattggatatctgcagagaaaattcaaaaggaacctcagtgtggaggcagaggttgatttactcagttattgtgcaagagaatggaaaggagagacaccccgtaacaagctgatgaggaaggcttatgaggagctattttggcggcatcacattaaatgtgttcgacaagtaaggagagataactatgatgctctcagatcagtgttatttcagatattcagccagggcatctcttttccatcatggatgaaagaaaaggacattgttaagcttcctgaaaaactgctgttttcacaaggttgtaattggattcagcagtacagttttggtcctgagaagtatacaggctcgaatgtgtttggaaaactacggaaatatgtggaattattgaaaacacagtggactgaatttaatggcattagagattatcacaagagaggaagtatgtgcaacacccttttttcagatgccattctggaatataaactttatgaagctttaaagttcatcatgctgtatcaagtcactgaagtttatgaacaaatgaagactaaaaaggtcattcccagtctttttagactcctgttttccagggagacatcctctgatcctttgagcttcatgatgaatcacctgaattctgtaggcgacacatgtggactagagcagattgatatgtttatacttggatactcccttgaagtaaagataaaagtgttcagactgttcaagtttaactccagagactttgaagtctgctacccagaggagcctctcagggactggccggagatctccctgctgaccgagaacgaccgccactaccacattccagtcttttaagtccgctgggggccgaacagcagtgctcaccagtgacggtggtcacagttgcaataaagtctctctctgaaaccaaagctagcatttcagcatggaaggaattaggaccttttcttcaggattacaggtacactggatgcagccatgcatggatggtttttctttatttttcagtgatttcctctgaagcagctgcactgatacatttgggagttggtggcttgactttgtccataaggggcgtggccacttcacatgatggcgggcctttaagagcacaaagaagtttaatatggacaacaacaggaaaaagcaagaagaaaacaagtagggaaaaacagctaacctggagagaaagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctggccagcttaatagttttatttagattttttaaaattctgtagattaaagcaaatgacagttattgaactatcacaaaactattaaactgtggtacatttaatgtgtatttaatgtgtggaatctcattatggtaggcagaataatgccctatgctccccaaagatgtctgtgtctgaatcctcagagccgtaaagggctaaatgggttaaatgggaaaggagaattaaggttgcaggtggaactgagatgctaatccaatgatgctgaaatagggagatttttctagattctccaggtggacgcagtgtaatcagaatggttcttaaaagtggaagagggaattggaagagtgtcagagtcagaggggaatgtgaaatatggaagaacggttagagagagatgcaccattgctggctttgaagatggaggaaggggccataagccagggagttgcaggcagcctgtagaattgagactggaaaggaaacagaaacttccccatagcctccagaaggaacgcagccctgccaacaccttgattttagcccagtgaagcctgtgttggacctctaatctgcagaactgtaagataatagatttgtgtttaagccactaagtttgtggtaatgtgttgtagcaacagaaaactagtattctcaggctagtttttggtcgtctttattttggaaatacttttctagtttaatttgatagttttttttttggaggtactttgctagtctgttttgagtttcagtacataagaataatttttaaaatcttgctaattatatattacttcaaagtcacaaatccctttctaagaatgacttacttcacgagatatttagcactatcattttcccagatgttcatattatttctgcaataaattaaaagggagtgtgtcaaatgctgtcatgtctgaaattagcattcatattcttttgcaatggggatgatcagtcgtgtgtactacatgaaccatgtctgatggtagcttgttcccactgtcattttgttttctggttgaagattaatgagctcagccacagaaacaagagttcttcattgacctctacagtccctgcctgtttggaaacatctatggttttgtataacccctgtcatttaactgacagtgttagaagatatccccctgatgtgttactgtaaccaagaaagcatgaacgttaccctttctggtgacagcctgccatgggctgctgtggctgatacttatagaattgttgctccaaaattttggctccacttgagctgtccagaagtgtacctgacatttgtgtattaccactcaccttggatctccttactagtgtaattatttccacatcaatccaggactgaaaggaaaaattttttcaccaggattggcagcctgtagctctgtgacctcagtcaacccatcatgttgtgttgtgggcggggggcaagaattctttagagaaccaagttgcgagaaagatttcaatccagtgaaagtaaaaagtaagaagacatttagatagttgctatattttgggaagatgtcaaaacaggtttttagggaggaggtatgaggtgttgtgttgttttgtttgtttttattcagttgtataatgaatataacaaattaagtagccagaaggagctgcatgtaaattagcaccacttttaaatgtcaacaataaatttgaggtgagcttcctgggtgatgccaacatttaaa

SEQ ID NO: 131793 - DNA, 2281 bp, Homo sapiens
  Payload ID: 5728
  Gene Symbol: FAM106A
  Gene Name: family with sequence similarity 106, member A
  Uniprot ID: Q4KMX7
  ENST ID: ENST00000392176
  CDS Start-End: 44-553
acaactggcctgaccttcaaaggccttcacagctcctgccttcatgttaccgtctactatgttcctcgtgcaccttccactcagcacaaacaggctgcactgcctccgaaacacatcacttgaatcctacctctgctcctttgtccatctgaatcaccctctccacatttctgaccgtgtaatcctgatctcacttcatgaggcagttcgcttctcttttgcatttagctttccccggggtacactgtcaatagcctactgtctgatgtcatcagtcagcacttcatcagaggcaattatgtccacagagcttttggctaattactgtcactcctctttacatgtgtgcatatgcatatcatctttccctaatgagactggaaatcatgattcattccctggagcagtggtttccataagtgaccaacccacagaccagtgcaaactggctgcaaaagagcttcctctgaggaacttattagaatgcagattctttgactgcatgggagaggaggatctcataaatctgggtgtaataggcacagaacgttaggtgtaatatgggcgggactctggactcagcatatccaacaagctgctggctgattccgacgatgccgatgaattgccaggttgggaactgctgcccccagagaacctagcagagagctctgtacgtggtaggtgctcactcccctattgtttgggtgtatgcctcctgataatgaacttgatcgtaactttattgttgtattatgcctgtattgtttccttaagtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcacgggaaaaaaacaaacaaacaaaaaggtttggtgaacactggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctcttctgtatggatctctcatcatagaggtgtgtgcatttctgactttgtgatttcaatactaaggaagctgtcggcagattatcaaggaaaacggggatcgctgctccccaacgtacacattctggtgtgccccagtaaaattctatattcagcctccaaactagctgggaaaaatgtggcaaatcatctacttgctccaattcaatggtgtttagaagtaggaagtcactgtgagcaatgccaccaagtggtggagagactccatgcagaatcgccaccttcagccagagaggctgggaggccgaagacctctctcaatgcacagggccattcagaaactagaaacaaaatgcttgctcatctccctaggccactccttccgaggctttttgagacgaggtctcactgtcacccaggccggagtgcagtggcacaatcaaggctcactgcaacctcaaccttctgggttcaagcgatcctcccacttcagcctttcaagtagctgggatgactacaggcatgggccaccacagccagctgattttttttttctttttagtagaaatgaggtctcgccatattgctcagactggtcttgaaccaacacatctttagctttttaaaagacagccttggccagccatggcagctcacacttgtaatcactgcactttcggaagctgaggtgggcagatagcttgagccgaggagttcaagaccagcctgggcaacatggtgaaaccccatctctacaaaaaatacaaaaattagctgggtgtgatggtgcacatctgtggtcccagctactggggaggctgaggtgggaggattgcttgagcctgggaggtcgaggctgcagtgagctgtgattacctcactgcattccagcctgggcaacagagaaccctgtctctattt

SEQ ID NO: 131794 - DNA, 3367 bp, Homo sapiens
  Payload ID: 5729
  Gene Symbol: FAM107A
  Gene Name: family with sequence similarity 107, member A
  Uniprot ID: O95990
  ENST ID: ENST00000360997
  CDS Start-End: 462-896
ctgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaa

SEQ ID NO: 131795 - DNA, 3465 bp, Homo sapiens
  Payload ID: 5729
  Gene Symbol: FAM107A
  Gene Name: family with sequence similarity 107, member A
  Uniprot ID: O95990
  ENST ID: ENST00000394481
  CDS Start-End: 560-994
ctgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaa

SEQ ID NO: 131796 - DNA, 1432 bp, Homo sapiens
  Payload ID: 5729
  Gene Symbol: FAM107A
  Gene Name: family with sequence similarity 107, member A
  Uniprot ID: O95990
  ENST ID: ENST00000447756
  CDS Start-End: 178-696
ttcccccggcggcgtctcctcgcccgcccctccggccgccgccgtaacttgaccctcagcggggtttgggacttggggccgcgtcaccgtcgcggaggcgcttcggctccggactacgctcctgctgtgcgctcgcggggccagcagtgctggctctgcagtaggaggcgcgggggcatggcgcagaggctgggcgagtgggcccgggggccctccgatgccaccgggctctaccgggctgtgctgctccggtcggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgtt

SEQ ID NO: 131797 - DNA, 580 bp, Homo sapiens
  Payload ID: 5729
  Gene Symbol: FAM107A
  Gene Name: family with sequence similarity 107, member A
  ENST ID: ENST00000465970
  CDS Start-End: 265-580
agttgaatgaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcaga

SEQ ID NO: 131798 - DNA, 2271 bp, Homo sapiens
  Payload ID: 5729
  Gene Symbol: FAM107A
  Gene Name: family with sequence similarity 107, member A
  Uniprot ID: O95990
  ENST ID: ENST00000474531
  CDS Start-End: 617-1144
agttgaatgaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccaggggaagaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 131799 - DNA, 2159 bp, Homo sapiens
  Payload ID: 5729
  Gene Symbol: FAM107A
  Gene Name: family with sequence similarity 107, member A
  Uniprot ID: O95990
  ENST ID: ENST00000464064
  CDS Start-End: 86-493
gctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccaggtgggtgatgggcacccagcagggaccacgcatcctccagggctgtcctccagggaggagctctgctgtggccacagctagtaagagggaagaggatcagcagacagagcactggactaagagtccactcctggcctgagtcctccctctgccattcactttgctaggtccttagggcgagtggcttccctgaacctcagcttcctcactggcccagtgtactgcatgctgattctgatttcattcttataactgtcttgtgagccaggtggcattcccattttagagatggggaagctgaggcccagagggggtgagtgatttgaaccaggctgcacaaggagaactcagtctcatgctctgtgccccagctaccaggctgatagcaaaactcatccccaggttggttctgtttccccactgagtgggcccttggtccaaactccacaggttttcagagtaggaatccccctagctccacccacttcactctctgcttctccctccttcagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 131800 - DNA, 3785 bp, Homo sapiens
  Payload ID: 5730
  Gene Symbol: FAM107B
  Gene Name: family with sequence similarity 107, member B
  Uniprot ID: Q9H098
  ENST ID: ENST00000181796
  CDS Start-End: 235-1155
acagaaggaagagcgcgaaattgcccaggatggacactttcaaaggggccccagcggctaagtgactctcagggaaggtggccttgccatcccaacttctatttaggggcaaccactagcaagttcttctcttcgggcaattggaaagagttcctataagcaaagtggaggtgatgtggacccctggaaaatttccttgccccgtttgaactttgcaatgattcactgcaagtcatgtccacgtggaaagcaagactcaccaaaagactgaagtctccctctagaagcatgcatccatttccgtgctcagctctgctcgcctgttttgggaatacgagggagagtgcttccttcaatcagtccggcgtggctgatactcattccaccgtccgtgtgcagcctgtggccaaagcaggcagacagccaagacacccaagcgcagaaggagctccagagaaaaggcaagattcgagcacccatgcagagagaaatggcagtgcgaatcggaattcaagtcaccgcactgcggcccagcccgcggagacgcctgaagatgtgcccgggtccctggatgatggggcggactgtgaagcagtggtgtttcacgcttccatccccagaccatcaattattgacacgcccaaggaagaagaatttcgagaagaacctaaatgcctcgagctggagcagaaaatgacatcagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatg

SEQ ID NO: 131801 - DNA, 1284 bp, Homo sapiens
  Payload ID: 5730
  Gene Symbol: FAM107B
  Gene Name: family with sequence similarity 107, member B
  Uniprot ID: Q9H098
  ENST ID: ENST00000378458
  CDS Start-End: 550-945
attgtttgctctggcttctgtgccggatgaggtcattcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttctt

SEQ ID NO: 131802 - DNA, 692 bp, Homo sapiens
  Payload ID: 5730
  Gene Symbol: FAM107B
  Gene Name: family with sequence similarity 107, member B
  Uniprot ID: Q9H098
  ENST ID: ENST00000378462
  CDS Start-End: 180-575
gtttctctttgaacttgaactgtggctcttttgatatccagaaagagagttctttgtggggatggttaattcttgttttgggtgcttttcttcaccgctctaaggaactaccacagtcagaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgc

SEQ ID NO: 131803 - DNA, 1052 bp, Homo sapiens
  Payload ID: 5730
  Gene Symbol: FAM107B
  Gene Name: family with sequence similarity 107, member B
  Uniprot ID: Q9H098
  ENST ID: ENST00000378465
  CDS Start-End: 262-657
agaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaa

SEQ ID NO: 131804 - DNA, 2374 bp, Homo sapiens
  Payload ID: 5730
  Gene Symbol: FAM107B
  Gene Name: family with sequence similarity 107, member B
  Uniprot ID: Q9H098
  ENST ID: ENST00000378467
  CDS Start-End: 302-697
gcggggccgcggggagcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaa

SEQ ID NO: 131805 - DNA, 3316 bp, Homo sapiens
  Payload ID: 5730
  Gene Symbol: FAM107B
  Gene Name: family with sequence similarity 107, member B
  Uniprot ID: Q9H098
  ENST ID: ENST00000378470
  CDS Start-End: 288-683
ggcccccgggggcttctgggagtgcctgccttcgcagctggagagagccctcctcaggggctgtctctgccttcccttcttcccatgtgtatctggggcagctgaggcagggctaggagaagagcccaggttcctcctgccacctccaagcgatgaagcagccctgggccaactccagcattctcgtgtgaactgcagaggagccctgcgcttccagctacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgcaa

SEQ ID NO: 131806 - DNA, 458 bp, Homo sapiens
  Payload ID: 5730
  Gene Symbol: FAM107B
  Gene Name: family with sequence similarity 107, member B
  ENST ID: ENST00000442012
  CDS Start-End: 187-458
aatgtgtgttagctgtggacttagaaaaaggaggccaccagaacaagctggaatcttggacagggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagtt

SEQ ID NO: 131807 - DNA, 834 bp, Homo sapiens
  Payload ID: 5730
  Gene Symbol: FAM107B
  Gene Name: family with sequence similarity 107, member B
  ENST ID: ENST00000452706
  CDS Start-End: 450-834
attcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagccc

SEQ ID NO: 131808 - DNA, 583 bp, Homo sapiens
  Payload ID: 5730
  Gene Symbol: FAM107B
  Gene Name: family with sequence similarity 107, member B
  ENST ID: ENST00000475786
  CDS Start-End: 279-583
attgagaagggaatgtgcttggtctgtcttctctctctgcttcgtcacctgccagtcctgagggccccaggcagcagtgcagctttaatgtggattcctatggatcagaggtgtcctagggctcacgttgttattctgcattgcacttgcagccaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgca

SEQ ID NO: 131809 - DNA, 790 bp, Homo sapiens
  Payload ID: 5730
  Gene Symbol: FAM107B
  Gene Name: family with sequence similarity 107, member B
  Uniprot ID: Q9H098
  ENST ID: ENST00000478076
  CDS Start-End: 222-617
atatcgagtattgagaagggaatgtgcttggtctgtcttctctctctgcttcgtcacctgccagtcctgagggccccaggcagcagtgcagctttaatgtggattcctatggatcagaggtgtcctagggctcacgttgttattctgcattgcacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagt

SEQ ID NO: 131810 - DNA, 549 bp, Homo sapiens
  Payload ID: 5730
  Gene Symbol: FAM107B
  Gene Name: family with sequence similarity 107, member B
  ENST ID: ENST00000482277
  CDS Start-End: 296-549
aactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctatt

SEQ ID NO: 131811 - DNA, 2633 bp, Homo sapiens
  Payload ID: 5730
  Gene Symbol: FAM107B
  Gene Name: family with sequence similarity 107, member B
  Uniprot ID: Q9H098
  ENST ID: ENST00000468747
  CDS Start-End: 207-602
gcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaa

SEQ ID NO: 131812 - DNA, 697 bp, Homo sapiens
  Payload ID: 5730
  Gene Symbol: FAM107B
  Gene Name: family with sequence similarity 107, member B
  Uniprot ID: Q9H098
  ENST ID: ENST00000496330
  CDS Start-End: 249-644
attcgtgggggaggtgtgtttgtggagtaaggcagtgggagggtagaggaaaaggagataaagaaaaagcccatttctaactctctgaacaggcgaggccagcttatctgagatgcctgtgatcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtg

SEQ ID NO: 131813 - DNA, 857 bp, Homo sapiens
  Payload ID: 5730
  Gene Symbol: FAM107B
  Gene Name: family with sequence similarity 107, member B
  ENST ID: ENST00000481209
  CDS Start-End: 258-413
ttcgcagctggagagagccctcctcaggggctgtctctgccttcccttcttcccatgtgtatctggggcagctgaggcagggctaggagaagagcccaggttcctcctgccacctccaagcgatgaagcagccctgggccaactccagcattctcgtgtgaactgcagaggagccctgcgcttccagctacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggattttggtctggttggaaatacattaaaaaaaaaaaaaagaaaaggcagatttcaaaatgaaatgaaaatatatctcatcttatctcttaagagttttcaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagca

SEQ ID NO: 131814 - DNA, 561 bp, Homo sapiens
  Payload ID: 5730
  Gene Symbol: FAM107B
  Gene Name: family with sequence similarity 107, member B
  ENST ID: ENST00000494865
  CDS Start-End: 188-561
ctgcaagtttagcactggcctgtcctgattagtgaggacctctgattgcctaggccagggctcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagt

SEQ ID NO: 131815 - DNA, 475 bp, Homo sapiens
  Payload ID: 5730
  Gene Symbol: FAM107B
  Gene Name: family with sequence similarity 107, member B
  ENST ID: ENST00000472095
  CDS Start-End: 273-475
gtgcttttcttcaccgctctaaggaactaccacagtcagaaggagaatgcagttgaaactaattttgtggatagagaaactgttggaactgctttacaaagtattttactctttcaagatcaaatgaagacagaattgttcaaagcgtgggttgacctcccctactcagtttttggctccttttggaaatctgatgtctgcccttctaagcgtaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagca

SEQ ID NO: 131816 - DNA, 570 bp, Homo sapiens
  Payload ID: 5730
  Gene Symbol: FAM107B
  Gene Name: family with sequence similarity 107, member B
  Uniprot ID: Q9H098
  ENST ID: ENST00000479731
  CDS Start-End: 143-538
atatttgcttacaagtagaggagctgatttttgtacagacaagtacatttcaccagtgctgccagcacgttctcttggtctggaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcacc

SEQ ID NO: 131817 - DNA, 559 bp, Homo sapiens
  Payload ID: 5730
  Gene Symbol: FAM107B
  Gene Name: family with sequence similarity 107, member B
  ENST ID: ENST00000489100
  CDS Start-End: 181-559
acttgtggctgagcagaggtgtatgtagtgcatttaggattttgccgaggagcacgtttttccatgggacagtgtgttgatatcaggctggctgtgatgggttccctgagtcaccctctgcgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgccc

SEQ ID NO: 131818 - DNA, 2317 bp, Homo sapiens
  Payload ID: 5730
  Gene Symbol: FAM107B
  Gene Name: family with sequence similarity 107, member B
  ENST ID: ENST00000487335
  CDS Start-End: 43-525
ttccttgccccgtttgaactttgcaatgattcactgcaagtcatgtccacgtggaaagcaagactcaccaaaagactgaagtctccctctagaagcatgcatccatttccgtgctcagctctgctcgcctgttttgggaatacgagggagagtgcttccttcaatcagtccggcgtggctgatactcattccaccgtccgtgtgcagcctgtggccaaagcaggcagacagccaagacacccaagcgcagaaggagctccagagaaaaggcaagattcgagcacccatgcagagagaaatggcagtgcgaatcggaattcaagtcaccgcactgcggcccagcccgcggagacgcctgaagatgtgcccgggtccctggatgatggggcggactgtgaagcagtggtgtttcacgcttccatccccagaccatcaattattgacacgcccaaggaagaagaatttcgagaagaacctaaatgcctcgagctggagcagaaaatgacatcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaa

SEQ ID NO: 131819 - DNA, 552 bp, Homo sapiens
  Payload ID: 5730
  Gene Symbol: FAM107B
  Gene Name: family with sequence similarity 107, member B
  ENST ID: ENST00000488576
  CDS Start-End: 274-552
gcttttcttcaccgctctaaggaactaccacagtcagaaggtgcattcttactgcgatctttttatttgctaccttgggcttaaggagcctgcctatatctactgagccagagaatcctggtcaagccctgaacagtccagaaactctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcag

SEQ ID NO: 131820 - DNA, 625 bp, Homo sapiens
  Payload ID: 5730
  Gene Symbol: FAM107B
  Gene Name: family with sequence similarity 107, member B
  ENST ID: ENST00000468492
  CDS Start-End: 234-625
acccagggctggagagtctgcgtgcatatttgcttacaagtagaggagctgatttttgtacagacaagtacatttcaccagtgctgccagcacgttctcttggtctggaaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtc

SEQ ID NO: 131821 - DNA, 3510 bp, Homo sapiens
  Payload ID: 5730
  Gene Symbol: FAM107B
  Gene Name: family with sequence similarity 107, member B
  Uniprot ID: Q9H098
  ENST ID: ENST00000622567
  CDS Start-End: 484-879
attgtttgctctggcttctgtgccggatgaggtcattcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgc

SEQ ID NO: 131822 - DNA, 3256 bp, Homo sapiens
  Payload ID: 5731
  Gene Symbol: FAM109A
  Gene Name: family with sequence similarity 109, member A
  Uniprot ID: Q8N4B1
  ENST ID: ENST00000361483
  CDS Start-End: 441-1229
aggggcgcgcccgtgggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagagtttgctgaggatgatggcttccagctccatctatttccccgcaaaggacatgatctcattcctttttatggctggatagttttccatggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagtaatggctgattgtgtcattttttttcccca

SEQ ID NO: 131823 - DNA, 571 bp, Homo sapiens
  Payload ID: 5731
  Gene Symbol: FAM109A
  Gene Name: family with sequence similarity 109, member A
  ENST ID: ENST00000547710
  CDS Start-End: 221-571
gtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcgg

SEQ ID NO: 131824 - DNA, 2846 bp, Homo sapiens
  Payload ID: 5731
  Gene Symbol: FAM109A
  Gene Name: family with sequence similarity 109, member A
  Uniprot ID: Q8N4B1
  ENST ID: ENST00000547838
  CDS Start-End: 99-848
attcctctgaaatgtctggcatgcagcaggaactcacaacattatttcagggatacaggagggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagta

SEQ ID NO: 131825 - DNA, 574 bp, Homo sapiens
  Payload ID: 5731
  Gene Symbol: FAM109A
  Gene Name: family with sequence similarity 109, member A
  ENST ID: ENST00000549321
  CDS Start-End: 351-574
gactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccga

SEQ ID NO: 131826 - DNA, 2317 bp, Homo sapiens
  Payload ID: 5731
  Gene Symbol: FAM109A
  Gene Name: family with sequence similarity 109, member A
  Uniprot ID: Q8N4B1
  ENST ID: ENST00000548163
  CDS Start-End: 105-854
aacattatttcagggatacaggagggtaggaggttatgaggctgtctggggaggcccgtgagacccaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactg

SEQ ID NO: 131827 - DNA, 2335 bp, Homo sapiens
  Payload ID: 5732
  Gene Symbol: FAM109B
  Gene Name: family with sequence similarity 109, member B
  Uniprot ID: Q6ICB4
  ENST ID: ENST00000321753
  CDS Start-End: 188-967
ggctcccgcggccacgttgcagcccaggcggaggcgcgggatctcgagctgggatcgccctcttgggcttcggtgcgatcggcggcgggaggttccctgggaaccaggtggtcgaagggctgagctgtgtggccagacaagaggtccctgccctcccccagtgagccctgctgttcccgtgggagccatgaagctgaacgagaggagtgtagcccactatgcactcagcgactccccagcggaccacatgggcttcctgcgcacctgggggggcccagggaccccaccgacccccagtggcactggccgaagatgctggtttgtcctcaagggcaacctgctattctcctttgagagtcgcgagggccgggccccactgagcctggtggtgctggaaggctgcacagtggaactggccgaggctcccgtgcccgaggagtttgcctttgccatctgctttgatgcccctggagtgcgcccacacctgctggccgcagaagggccggcggcccaggaggcctgggtgaaggtgctgtcccgggcaagctttggctacatgcgcctggtggtacgcgagttggagagccagttgcaggacgcacgccagagcctggctttgcaacgccgctcatcctggaagtctgttgccagccgctgtaagccccaggctcctaaccaccgagctgcgggcctggagaatggccactgcctctccaaggacagcagccctgtgggcttggttgaagaagcgggcagcaggtctgcagggtgggggttggctgagtgggagctgcagggccctgccagcctcctcctaggcaaggggcagagccctgtgtcccctgagacctcctgcttctctaccctgcatgactggtatggccaggagatcgtggagctgcggcagtgttggcagaagagggcccaggggagccactcaaaatgtgaggaacaggataggccctaagtctgggccctttgagtcaggaaaccagggccagttctttttcaggagttaaatgtttacccatttccaaggttgcgttttgggaggggacatgggttctctccttcctgctatttaggcattctccaggttcgagatccacccgtgtgtctggaagggactgcgggaccattccttccatcctctttatttcctgaggtccagagaaggaaggagacttagcagccacagagcaagaccccaatctcctgactgcactggcctgactgccccctcccaggggatgttaatgaaatgaaggaagtggggaatgtcacccgagactgtcacaggcttgccatacctttggcctacacaccgggctctagagccataatttccaacctggggagtctcctgtgcacttaaatccgaggtaggctgcagtatcggcttgaagctctgacactgtcagagaaagtggatttattgtgtcataggagtttctgggacccagctcttcctgagaggggtgggaagattggggatgggatcctcactcagcagtctgggtagggccctttgaggcagagggtcttcggccagtgaagagagatttattctgctcagagtgctggggtcccatcctttctccctggctgccctgttaacagatggtgctggaccttgccccggaaggggcttgtagcttttttacgtcaacgaaatgccctcctgtactctgtcttcagcagccaactcctggagctgccaagtgaggggttaaagaagaggtggggaggcagtgtggctccctgggaaaagtctgttgctttggttctcagtcctgggtattctaggagcttggacacgggattgcgtttcctgtgctaaaattctctctcctggctgggctccggtaaactgaagctgctcgagaaatcacctgggaactctcatagccgtttgtcacccagggtgtacttgccaggacctctccttgctactcttcccaaagtcgggaggcaaagcggctgggtcaccagagcctgaccatactgacgctccagggggaagacgcagaggccgggaagagacaccccctcccaaacacataaaacttgccccttcctagcctcggctcccctcactggggccttgggcaggaccgacccgcatccaactaggcctaaggggtaggctctgagcctcttacccctaagaggcggagatgcgcccaaggcgggcgcccggcctgttccccagccctgcctggaagccccgcagccactgcattttgtttaaacacagatagcacgggcctttctcttattgctacagtgttttgtacacggttaaaacactagtaaagctttttcgttattactc

SEQ ID NO: 131828 - DNA, 537 bp, Homo sapiens
  Payload ID: 5732
  Gene Symbol: FAM109B
  Gene Name: family with sequence similarity 109, member B
  ENST ID: ENST00000419475
  CDS Start-End: 213-537
gcgggctccgggaggaggtggccccagggaaggtgtggccgcggggaagtggcggcgaacagccccgacgcgaggacggggaaaccaaggcggcagccagggagaccctgaccgaggttccctgggaaccaggtggtcgaagggctgagctgtgtggccagacaagaggtccctgccctcccccagtgagccctgctgttcccgtgggagccatgaagctgaacgagaggagtgtagcccactatgcactcagcgactccccagcggaccacatgggcttcctgcgcacctgggggggcccagggaccccaccgacccccagtggcactggccgaagatgctggtttgtcctcaagggcaacctgctattctcctttgagagtcgcgagggccgggccccactgagcctggtggtgctggaaggctgcacagtggaactggccgaggctcccgtgcccgaggagtttgcctttgccatctgctttgatgcccctggagtgcgcccacacctgctggccgcagaagggccggcggccc

SEQ ID NO: 131829 - DNA, 1619 bp, Homo sapiens
  Payload ID: 5733
  Gene Symbol: FAM110A
  Gene Name: family with sequence similarity 110, member A
  Uniprot ID: Q9BQ89
  ENST ID: ENST00000246100
  CDS Start-End: 145-1032
ctttacaagtatgaactcatttaattccctcaactctgtgatataagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 131830 - DNA, 1856 bp, Homo sapiens
  Payload ID: 5733
  Gene Symbol: FAM110A
  Gene Name: family with sequence similarity 110, member A
  Uniprot ID: Q9BQ89
  ENST ID: ENST00000304189
  CDS Start-End: 382-1269
cacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccaggtggctgaccacgtccacgaccacatctgcctctaaactggaattcggttgctgacccagccccagcctcggctttcttgtcagcaccagggggcacagaacaccgtctcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 131831 - DNA, 1737 bp, Homo sapiens
  Payload ID: 5733
  Gene Symbol: FAM110A
  Gene Name: family with sequence similarity 110, member A
  Uniprot ID: Q9BQ89
  ENST ID: ENST00000381939
  CDS Start-End: 263-1150
tcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 131832 - DNA, 1809 bp, Homo sapiens
  Payload ID: 5733
  Gene Symbol: FAM110A
  Gene Name: family with sequence similarity 110, member A
  Uniprot ID: Q9BQ89
  ENST ID: ENST00000381941
  CDS Start-End: 335-1222
acttccccttccacggcgccccagggactttccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 131833 - DNA, 1614 bp, Homo sapiens
  Payload ID: 5733
  Gene Symbol: FAM110A
  Gene Name: family with sequence similarity 110, member A
  Uniprot ID: Q9BQ89
  ENST ID: ENST00000541082
  CDS Start-End: 140-1027
ccgggccggaggagcgcaggccagcggcgcgggcgcagccggcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 131834 - DNA, 1328 bp, Homo sapiens
  Payload ID: 5733
  Gene Symbol: FAM110A
  Gene Name: family with sequence similarity 110, member A
  ENST ID: ENST00000505691
  CDS Start-End: 1-569
tcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagagcctccaggtgggtgtatggacactccaaaacagccatccctgtcaatgaatcagcctgcagggactgaattcattccttcattcatcaatatccattgagcacctactgtgtgccaaacactcttctaggaactgaagatgcaacagaaaacaaaacagataaaaatccctgccctcgaggagctgacattccagaggggacacagacaatacttgccagagtgaaaatgctaaggagaaaaatgaagcagggaaggatggggaactagagattttttttcctttttttattgaggttgaattgataaacaataaaattggcccattttaggtgtacagttggatgcattttgacagttgtatggcactacagacaagtgctagaattcctgtatcatcccaccatgttccttcacgccccccacagtcagcccctgactcccacccgctcccacccgaagaaactacagatcagttttctttcactgtagatcagctttgtctttcccagagttcatgcaaatggaatctggcttctctcagtcagcatcatggacttggttgagattcgcccgtgttgctgagtgtatctgtagcttgttcctttttactgacgagtagtattccacagtgtggatgcactgtattttgtttattcatccaacttgttgacggacatacaggttgttcccatttcttggctattacaaataaa

SEQ ID NO: 131835 - DNA, 3438 bp, Homo sapiens
  Payload ID: 5734
  Gene Symbol: FAM110B
  Gene Name: family with sequence similarity 110, member B
  Uniprot ID: Q8TC76
  ENST ID: ENST00000361488
  CDS Start-End: 881-1993
actcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccagaaatctccaaattggacatccagagcagcattcttgttctgtctacgtcttgaattagaaactatcaagctctgtaagtcctgaaaaggaaataaaaggtgcgtccctacccaagaggagaggtggccagtaaatgtcagctgaggcaccgaaggctgcgatgcaccagcccggtgccctgtgaggacggccacatcaatagtggtaacactcacaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaa

SEQ ID NO: 131836 - DNA, 3760 bp, Homo sapiens
  Payload ID: 5735
  Gene Symbol: FAM110C
  Gene Name: family with sequence similarity 110, member C
  Uniprot ID: Q1W6H9
  ENST ID: ENST00000327669
  CDS Start-End: 1-966
atgcgcgccctggcggccctgagcgcgcccccgaacgagcggctccttccccgggaccccgcggctacccgggaccccgacgccgcgcggccggcgcgcaggagcgcagtggagaggctggcggcggatcgcgccaagtatgtgcggggtcggccggggactggccggggcgtcgcttccgagggcagcggcccgggggcgatcaagtgcccggggaacgaccctgggcccccggcccgcgccccggccccggtggcgcgcagggctattgcgcggaagccgttgagaccggactcgctgatcatctaccggcagaaatgcgaattcgtgcgaggatcgggcgccgacggccccagggcaagcctggtgaagaagctcttccaggggccgggtaaggacaaggcgccggtgccccggacgggagacgagggcaaggccgggaacccggagacggtcccgaccactcctggccccgcggcggaccccgcaatccccgagaccccagccccagccgcgcggtccgcggcgccctccagtgtcccggccgcgccccctgggccagagccgcgggtggtgaggcgtcgggggctgcagcgctcacagtcggacctcagctcccgctattccgctgccttggccgagtctgacaccttcttccagtactgcggcctggaccccgaggtggtggaggccctggggagggagaacttcaccgcggggtcggactgtgtgaccctcaaggtgcgcagcgtgagcgtcgccacctccggcagcggcttctcccggcacagcggcggcgacgacgaggggctgcaggaggaggagctgatagagcaggtgcccagcaccacttcggtcatcgagaggaacgcccgcatcatcaagtggctgtacacctgtaagaaggccaaggagacccccagccaggagcagagccggacccgaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagaaaactttggtttacacagaacacgggcatctgaggcaggacctcttccctgccctttgatctgactcacacctccacatatgacgtaatcaacccaaatttgacaccaattcactcttttctgcaaagggcatattttgaaacaagggacagcctgagggcggctataatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaa

SEQ ID NO: 131837 - DNA, 2858 bp, Homo sapiens
  Payload ID: 5736
  Gene Symbol: FAM110D
  Gene Name: family with sequence similarity 110, member D
  Uniprot ID: Q8TAY7
  ENST ID: ENST00000374268
  CDS Start-End: 188-1003
gagtgaggtttggctgccaccaaagttacttctagtccttgctgtccactcctgccctcagtctggacctgcccaaggacccctgcaattaggcctcccatgcagaggtcagtgagagcccaagccaattgctctaggccccgtggctggctacttatggggcactgtcctgaccagctctgctaagatgctcctggcccctccctccaccccgtccagaggacggacccccagcgccgtggagaggctggaagccgacaaagccaagtatgtcaagacgcaccaggtgatagctaggcgacaggagccagccctgcgtgggagtcctgggccgctcacgccgcacccctgcaacgagctggggccccctgcatcgcccaggacgcccaggccggtccgccggggaagcggcaggcggctgccgaggcctgattccctcatcttctaccgccagaagcgggactgcaaggcttcggtgaacaaagagaacgccaagggccagggtctggtgcggcgcctctttctgggtgccccgcgggacgctgccccgagcagcccggcctccacagagcgacctgcggcttcagggggttgggctgcgccccaggatgccccggaagcggcgggaaagcgggcgctgtgtcccacgtgctcgctgcccctgtcggagaaggagcgcttcttcaactactgcggcctggagcgcgcgctggtggaggtgctgggcgcagagcgcttctccccgcagagctggggagccgacgccagcccgcaggccggaacttcgccgccgcccggctccggggacgccagcgactggacatccagcgacaggggcgtggacagcccgggcggcgcgggcggcggcggcggctcggaggcagcgggctcggcgcgggaccggcgccccccggtgtcggtggtggagcgcaacgcgcgcgtcatccagtggctgtacggctgccagcgcgcccgcggaccgccgcgcgagtccgaggtgtgaccgccgcggctccggactggccccgggactggccccgggcacggaaaaggacacccctcttctggcgcgctgggtgcctttgcgtaagcccttccttctggaactcagtttcgcgtctgaaccttggggaggtggaacaagttgctgccgaaggcccttccctgctcccgcggcgaagggggagggagaggcctcttggtccctgtggagacccggtctggggagtcacgattggggtgggagatgagcaaacctgctgaataaagttaaaacgttatttaaatggggagctgaggaaggagcaaacgggttttcgcggttaaacccgtgggttttggaatgtgtgttcccggctgtgtgatcctgggcaagaacttgacctccctggacgcagcggcacccctcggttattaaggagggaggagtaggggatagaagtatttcaaaatagttgtaatgcgcatggcaaagtgcccagcatatagaaagtgctcaataaacgataactgctgtgacttctaccgaatgagtactaacactgttgtgatctccactggcctccaggtcgatccaaactagagctgggagctgggaataatgcgctttgggagcccgaggaggcgtctgctccagaaatctgggctccaccagatcctaaaaggccccattcccggagttttgctgccccagttgtggtcactgggtatgaagggctgagatccaacctttcggacacaaaaagaagggaaccgggccgggcgcggtggctcaggcctgtaatcccagcactttgggaggctgaggagggtagatcacgagatcaggagttcgagaccagcctggccaacatgggctctactaaaaatacaaaaattagctgagcttggaggcgcgcgcctgtaatcccagctactcgggaggctgaggcaggagaatcgcttgaatcccagaggcggaggttgcagtgagccgagatcgagccattgcactccagcctgggcaacagggccagactccgtctcaaaaaataaaaataaaaataaaaaaagaaaagaaggaaacctttcctgccagccggcaggctcctgccactgcctccctttcctgcaaggacacacaagttcgcctattttcatcacaggttcgcacctccaagcctgcatccttcatgcacctccttcctttgcctgggttgccgttccttttctctctgctcttccttctcttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccccttcttccttctcggagataacgtatattctcctccaggaagccgtcctgaatgcccccagtcagcctcacctgctctgagctcccaagtacagtcctatttttgggcctcaatttgtcaccttttgtgggacccgctggtactctgggttctctagttaatctttgacctttttcctagtacagggacggcgcacatagtagggccacaggcacagtttgttgaattaaatgaggctggagagggcgatggacgcagtcctctggagctctccaacttcctggaaagttgtaccttaaataaaaaacccatcctga

SEQ ID NO: 131838 - DNA, 3592 bp, Homo sapiens
  Payload ID: 5737
  Gene Symbol: FAM111A
  Gene Name: family with sequence similarity 111, member A
  Uniprot ID: Q96PZ2
  ENST ID: ENST00000361723
  CDS Start-End: 225-2060
ctagccccacctgctccgtttcccgcccagctggagctctggagcctttgcttcctcaaatacgagcgggaactgcgttgagcgctggattccaggccgagtgctggcgaggcgcgcagttctctgctgtttaaaaagtatccctgtgctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgag

SEQ ID NO: 131839 - DNA, 3780 bp, Homo sapiens
  Payload ID: 5737
  Gene Symbol: FAM111A
  Gene Name: family with sequence similarity 111, member A
  Uniprot ID: Q96PZ2
  ENST ID: ENST00000420244
  CDS Start-End: 415-2250
ctccagcccggcccaggccagcctaccggcgactaggatgctttcgctttcgctctcgctttccaatactcgggactggggaaaccgggagaatagaagcaggcaaggaccgccgtgggcacggggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctg

SEQ ID NO: 131840 - DNA, 3996 bp, Homo sapiens
  Payload ID: 5737
  Gene Symbol: FAM111A
  Gene Name: family with sequence similarity 111, member A
  Uniprot ID: Q96PZ2
  ENST ID: ENST00000531147
  CDS Start-End: 629-2464
gactatcatccctagcaaactttccagatttctttttaaaatctcattccaagtttctttcctcagctctatcctcaccacttccctgtaattttatctccccttgccatcttcatcttaaatgaataacagattttaacatcaatgtaactagaacagctttttgaaatttccaactgaaaattattctattatttatacttgcatttgaattccatctctgccacatagctctggccttgggcagttcgtctaccttctctaagctatactttccccatcagcaaagtgtagctatacctaatttgcatagcatccgcaggaatttgcagctagagataattttcataaagtgtttagtataattttcatgaagtgcctgacacgcagtgttctcgaaaagagagcttttattgttaaggtgattatagttggtgaataaactatctatttgctaaggtaccatctccagggagagcaaggttggagcctaaggggaaagatgggacgcaggacaccagctaatcttttcctctgtacaattaatgacagctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgag

SEQ ID NO: 131841 - DNA, 423 bp, Homo sapiens
  Payload ID: 5737
  Gene Symbol: FAM111A
  Gene Name: family with sequence similarity 111, member A
  ENST ID: ENST00000531408
  CDS Start-End: 136-423
tcccgcccagctggagctctggagcctttgcttcctcaaatacgagcgggaactgcgttgagcgctggattccaggccgagtgctggcgaggcgcgcatgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctc

SEQ ID NO: 131842 - DNA, 4202 bp, Homo sapiens
  Payload ID: 5737
  Gene Symbol: FAM111A
  Gene Name: family with sequence similarity 111, member A
  Uniprot ID: Q96PZ2
  ENST ID: ENST00000533703
  CDS Start-End: 832-2667
tagtgctgcaagtccccttgtgtgctggggggagcggggcggcgtggtaggattggaagaggcttagagttggcctcgacccctgcccttgcccctggaaaggcagaaagtgggggttggggtgcggagaagcaggaagagagggagagtgaaggaggggaggaaagggagagaggaagagggagagtgaaggaggggaggaaagggagagaggcagagagggggaaggagagagggaaggaaggagagattgagagacagagaaattcctaaggggagctgtcaggtgggctggacatgggccccaggctgcactgctttatccctttgctgtaggaagtcaagcaagttctttaggtaagtagaaccttgatgtcaagtataaaacaggggttggtataggatagctaagagcactttatattttgatataatctgatttatcctggatactgaaaacaatgtagggagacggaggatattggagtgttttcttaacctcttgcccctttccactgtgattgctcaagtacatgcaaaattaatgtttctttctgcccattttattttcctttttttgtctgtgtctattaatcattcctaaagcacccggatcctctctcaaacttcgtaagatgagacatcatgaacagacacagtgaatccctagattttcttaatagttgggcaacaagttcttgcatttagggatgttgcaacatagcccagttccgcaattgtacattttctattttttttcctaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaa

SEQ ID NO: 131843 - DNA, 6189 bp, Homo sapiens
  Payload ID: 5737
  Gene Symbol: FAM111A
  Gene Name: family with sequence similarity 111, member A
  Uniprot ID: Q96PZ2
  ENST ID: ENST00000528737
  CDS Start-End: 2819-4654
ctccgcttcctgcgcgcgcgagactcaagctgccacagtggctctgccgccagcgtcccagctcctcccacacccgagtttttatttcctgctccctctccagcccggcccaggccagcctaccggcgactaggatgctttcgctttcgctctcgctttccaatactcgggactggggaaaccgggagaatagaagcaggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcaggtatgttcactattgtgagaactgaagccatctacactcacatagcttgccaactacattaacctgacttcttattccattattttcatcaacatacatttactatttcaagaaacttttgccagggaccggaaagttgcaaatatctttattgcttaatccagtatcttcttcaaagatccaaccactcttcaatggaaaacatcaaagaacagtttacattctaagactttgaacctttacctcaaaatcctagccttgttttatctaccaatcctaaacttttacccgtagctgactcaattctaaccaattcccctcattaaatattagacttacaatgggacttcaaaatctcaatacatatagcccaaacttgctcttccctctctgagacaccacttaaattctgtcaagttattgttctccattacctaagtgagcaagaaacttagctttgtcttatcaacaggttgctttgatattactgggagccaacatttgacattcttggaggctccagcaagacctaatcaacctcccaaccctcaactcagaatcagtgtgtgccctgaagtcccttcaaccttcttgaggctctccctgatctcaaaggtggagaaagtagatcttgcatcaggttgaactccagtttctttttgctcagtttttcaagcgctgagtttattttgtccctaggcataaagaaatctttctaggaacccctttggttatgggaccagatttttaaaagctttttaggcttggtgaaaaatctgccttatcactagcaacactacgacttgtctctgttcttgttttttgttgtactcgtgtaaaagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaaagaaagtaaccaattggttcgcagacaaccttttcccaaaaggcgggcgattcaaacccctagccccacctgctccgtttcccgcccagctggagctctggagcctttgcttcctcaaatacgagcgggaactgcgttgagcgctggattccaggccgagtgctggcgaggcgcgcagtgagtgagcacacagggcgctggggtgctccgcggggcgcggtcacgggcgcggccgcggcgggctcgagtcccggctgggaggagaaggagctgggtgtcaggaagccggggactgacagcgccacccatctggggagccgggaggacacaggttttattttggtagtgctgcaagtccccttgtgtgctggggggagcggggcggcgtggtaggattggaagaggcttagagttggcctcgacccctgcccttgcccctggaaaggcagaaagtgggggttggggtgcggagaagcaggaagagagggagagtgaaggaggggaggaaagggagagaggaagagggagagtgaaggaggggaggaaagggagagaggcagagagggggaaggagagagggaaggaaggagagattgagagacagagaaattcctaaggggagctgtcaggtgggctggacatgggccccaggctgcactgctttatccctttgctgtaggaagtcaagcaagttctttaggtaagtagaaccttgatgtcaagtataaaacaggggttggtataggatagctaagagcactttatattttgatataatctgatttatcctggatactgaaaacaatgtagggagacggaggatattggagtgttttcttaacctcttgcccctttccactgtgattgctcaagtacatgcaaaattaatgtttctttctgcccattttattttcctttttttgtctgtgtctattaatcattcctaaagcacccggatcctctctcaaacttcgtaagatgagacatcatgaacagacacagtgaatccctagattttcttaatagttgggcaacaagttcttgcatttagggatgttgcaacatagcccagttccgcaattgtacattttctattttttttcctaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaa

SEQ ID NO: 131844 - DNA, 867 bp, Homo sapiens
  Payload ID: 5737
  Gene Symbol: FAM111A
  Gene Name: family with sequence similarity 111, member A
  ENST ID: ENST00000527629
  CDS Start-End: 318-867
ctagccccacctgctccgtttcccgcccagctggagctctggagcctttgcttcctcaaatacgagcgggaactgcgttgagcgctggattccaggccgagtgctggcgaggcgcgcagttctctgctgtttaaaaagtatccctgtggtaccatctccagggagagcaaggttggagcctaaggggaaagatgggacgcaggacaccagctaatcttttcctctgtacaattaatgacagctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaat

SEQ ID NO: 131845 - DNA, 3488 bp, Homo sapiens
  Payload ID: 5738
  Gene Symbol: FAM111B
  Gene Name: family with sequence similarity 111, member B
  Uniprot ID: Q6SJ93
  ENST ID: ENST00000343597
  CDS Start-End: 192-2396
aaatccagagcggcgggcactgacgggcacttgcaccgtgtggacagactctccggttctggggaaatccagtccctgttactccattttggccagaaattcaagacatttcaggtggcagaataaattcaatccttgtttctccatcttatcgagtagtagaagttagttacattctctttgaactcatcatgaattccatgaagactgaagaaaacaagtcatttagcgctatggaagatgaccagaggactagacctgaagtttcaaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaacaagcaaccccattaaaaagtgggcaaaggacatgaacaaacacttttcaaaagaagatatacacatggccaacaaggatatgaaaaaatacctgatatcactaatcattagagaaatgcaaatcaaaaaaatgccatcacactaatcagaatggctgttattaaaatgccaaaaaattacagatgctggcgaggttgcagagaaaggggaatgcttatacactgctagtgggaaaataaattagttcagccattgtggaaagcagttgggtgatttctaaaagaacttaaaacagctaccattcaagccagcaatctcatgactgggtatatgtccaaaggaatataaattgttctaccataaagacatgcacatatatgttcactgcagcactattcacaatagcaaaacatgaaatcaacctaaatgcccatcaatggtagactggataaagaaaatgtgacacatatacaccatagcatactacacagccataaaaaagtacaagatcatgtgctttgcagcaacatggatggaactgaaggtcattatcctaagcgaactaatgcaggaacagaaagccaagtaccacatgttctctcataagtggaagctaaatattgagtacacatggacacaaagaagaaaacaacagatatggggcctacttgagggtggagggtgggaggagggtgaagactgaaaaactgcctatggggtactatgcttattacctgggtgatgaaataatctgaacacaaaaccctggtgacatgcagtttacctatataacaaaactgcacatggactcttaaacctaaataaaagttta

SEQ ID NO: 131846 - DNA, 3344 bp, Homo sapiens
  Payload ID: 5738
  Gene Symbol: FAM111B
  Gene Name: family with sequence similarity 111, member B
  Uniprot ID: Q6SJ93
  ENST ID: ENST00000411426
  CDS Start-End: 122-2236
gcgggaaaagttcagctgagagatataaaagagcagtctttccagcacctgcaaatccagagcggcgggcactgacgggcacttgcaccgtgtggacagactctccggttctgatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaacaagcaaccccattaaaaagtgggcaaaggacatgaacaaacacttttcaaaagaagatatacacatggccaacaaggatatgaaaaaatacctgatatcactaatcattagagaaatgcaaatcaaaaaaatgccatcacactaatcagaatggctgttattaaaatgccaaaaaattacagatgctggcgaggttgcagagaaaggggaatgcttatacactgctagtgggaaaataaattagttcagccattgtggaaagcagttgggtgatttctaaaagaacttaaaacagctaccattcaagccagcaatctcatgactgggtatatgtccaaaggaatataaattgttctaccataaagacatgcacatatatgttcactgcagcactattcacaatagcaaaacatgaaatcaacctaaatgcccatcaatggtagactggataaagaaaatgtgacacatatacaccatagcatactacacagccataaaaaagtacaagatcatgtgctttgcagcaacatggatggaactgaaggtcattatcctaagcgaactaatgcaggaacagaaagccaagtaccacatgttctctcataagtggaagctaaatattgagtacacatggacacaaagaagaaaacaacagatatggggcctacttgagggtggagggtgggaggagggtgaagactgaaaaactgcctatggggtactatgcttattacctgggtgatgaaataatctgaacacaaaaccctggtgacatgcagtttacctatataacaaaactgcacatggactcttaaacctaaataaaagtttaaaatatatataatgcc

SEQ ID NO: 131847 - DNA, 557 bp, Homo sapiens
  Payload ID: 5738
  Gene Symbol: FAM111B
  Gene Name: family with sequence similarity 111, member B
  ENST ID: ENST00000534403
  CDS Start-End: 70-557
aaatccagagcggcgggcactgacgggcacttgcaccgtgtggacagactctccggttctgatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaag

SEQ ID NO: 131848 - DNA, 2364 bp, Homo sapiens
  Payload ID: 5738
  Gene Symbol: FAM111B
  Gene Name: family with sequence similarity 111, member B
  Uniprot ID: Q6SJ93
  ENST ID: ENST00000529618
  CDS Start-End: 116-2230
caaatccagagcggcgggcactgacgggcacttgcaccgtgtggacagactctccggttctggggaaatccagtccctgttactccattttggccagaaattcaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaag

SEQ ID NO: 131849 - DNA, 3405 bp, Homo sapiens
  Payload ID: 5738
  Gene Symbol: FAM111B
  Gene Name: family with sequence similarity 111, member B
  Uniprot ID: Q6SJ93
  ENST ID: ENST00000620384
  CDS Start-End: 93-2297
ttttagacatttcaggtggcagaataaattcaatccttgtttctccatcttatcgagtagtagaagttagttacattctctttgaactcatcatgaattccatgaagactgaagaaaacaagtcatttagcgctatggaagatgaccagaggactagacctgaagtttcaaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaacaagcaaccccattaaaaagtgggcaaaggacatgaacaaacacttttcaaaagaagatatacacatggccaacaaggatatgaaaaaatacctgatatcactaatcattagagaaatgcaaatcaaaaaaatgccatcacactaatcagaatggctgttattaaaatgccaaaaaattacagatgctggcgaggttgcagagaaaggggaatgcttatacactgctagtgggaaaataaattagttcagccattgtggaaagcagttgggtgatttctaaaagaacttaaaacagctaccattcaagccagcaatctcatgactgggtatatgtccaaaggaatataaattgttctaccataaagacatgcacatatatgttcactgcagcactattcacaatagcaaaacatgaaatcaacctaaatgcccatcaatggtagactggataaagaaaatgtgacacatatacaccatagcatactacacagccataaaaaagtacaagatcatgtgctttgcagcaacatggatggaactgaaggtcattatcctaagcgaactaatgcaggaacagaaagccaagtaccacatgttctctcataagtggaagctaaatattgagtacacatggacacaaagaagaaaacaacagatatggggcctacttgagggtggagggtgggaggagggtgaagactgaaaaactgcctatggggtactatgcttattacctgggtgatgaaataatctgaacacaaaaccctggtgacatgcagtttacctatataacaaaactgcacatggactcttaaacctaaataaaagtttaaaatatatataatgcc

SEQ ID NO: 131850 - DNA, 4050 bp, Homo sapiens
  Payload ID: 5739
  Gene Symbol: FAM114A1
  Gene Name: family with sequence similarity 114, member A1
  Uniprot ID: Q8IWE2
  ENST ID: ENST00000358869
  CDS Start-End: 177-1868
gtactcggccgcctgagcgccgacccacgccctgcctgctcttccagtccagccaacactctaagcaggcaccgcctccactcgcagcccccgggatgggtcccactccctaccgcagatccccaggccccctccacccagtcggctagccctcgcctctgccatccgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccaccgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagatttttccccttt

SEQ ID NO: 131851 - DNA, 567 bp, Homo sapiens
  Payload ID: 5739
  Gene Symbol: FAM114A1
  Gene Name: family with sequence similarity 114, member A1
  ENST ID: ENST00000510213
  CDS Start-End: 167-567
ggccgggcgtccccgcggcgctcctcgtggggcggggcgcaggcggggcggggccccctctccagccgcccgccctccggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctgggg

SEQ ID NO: 131852 - DNA, 1431 bp, Homo sapiens
  Payload ID: 5739
  Gene Symbol: FAM114A1
  Gene Name: family with sequence similarity 114, member A1
  Uniprot ID: Q8IWE2
  ENST ID: ENST00000515037
  CDS Start-End: 358-1428
ctccggccgcgtccccgccggccctgcagacgtggcggggcgggacccgctgggcactcccgcgcgtactcggccgcctgagcggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacct

SEQ ID NO: 131853 - DNA, 4443 bp, Homo sapiens
  Payload ID: 5740
  Gene Symbol: FAM114A2
  Gene Name: family with sequence similarity 114, member A2
  Uniprot ID: Q9NRY5
  ENST ID: ENST00000351797
  CDS Start-End: 78-1595
ttccggggcagtaggaacgccgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcgtcttcctaaaagctattttggtatccactctttttaaaaaaattctccaactttgtggttttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataacatagattagtataaagactgtttctacgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttctgaagtttcagaaaaacagttgccttctggttacaaaggctggtgtcaccagttctgaattgttgcctcaagcttggttgatgtgtctgaacctgtatcccttgagggcaaagtttagaaactggtcactctgcctactgtctgttcagcctcttgtacaatggcagtttggcagctttaaatccttaacctagaaatgtatttaaggtttttctttcaagaaatggggtatacatatgaaggagagagtaacaactctttttatacacctattcagatttcagccctgaatttggcaaattttagattaggtctcacataaggtaaatatgactcactaactctttttttctcatcttccccacccccccatatatatttatttattttaatggagttagggaccactagtgaaatgatgaaaggcccaattctgagtaacaattgtctactcttcacataaaatatactgaaaaagaattaagattccttgatccagtagacatagagaaacataaacattcatgacagatgagtaggtaaattcagggatcactttggaacttgctggattatggtgatggtttttggatagtatgtgcttcattattttatttggggtagttacagtgttttagttttttgttaacagctacacttttggtactattttccttttaaatttttggtgtctaagatttaccactaattactaatatatgcctttccaattcacttaaaaccttaataagtgaaatgttcaggtattgctagggtaaatgtgtcttttcctactattgagattttaaaaggctgtgattaagagagactttattaatttgatctgaaagaagtagaaacctctatgaaacaatttttattttcctttgcataataccttagaaatgtgttaaggacaagctatattttccttacttgcttttgatagtttttttttttttttttaagcatagatatccaggttggcaggcctctgaaatgtgaaattgtaatttttatagatggcattactatgaatctgaaatcagtgctaggtgtacaaatgtgaatttttcaatcctgtaatcaaagaacaagatcttgtgggttcctactgctgaaaaaggatgctttcttttgtacttgtttttagtgaaagacctttttgagggagagctattttataggtagttgctattgatatctccatttgagaaatagacatttttctgtatttctagaggtgttctgaattttaaacctgaattcttcagtttagaaaacccagaataaaattatacccacagtgggcactcaacaagtgtgatatttcacaaa

SEQ ID NO: 131854 - DNA, 550 bp, Homo sapiens
  Payload ID: 5740
  Gene Symbol: FAM114A2
  Gene Name: family with sequence similarity 114, member A2
  ENST ID: ENST00000518102
  CDS Start-End: 241-550
agtaggaacgccgagtcggctgccgtggctgtgctgagggtggcggccggataggtgcggagcttcctgaacgaggcaggagggggacccagaactccatttgacagatgaggaaacggagaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtag

SEQ ID NO: 131855 - DNA, 576 bp, Homo sapiens
  Payload ID: 5740
  Gene Symbol: FAM114A2
  Gene Name: family with sequence similarity 114, member A2
  ENST ID: ENST00000523705
  CDS Start-End: 78-576
gagtcggctgccgtggctgtgctgagggtggcggccggataggtgcggagcttcctgaacgagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaa

SEQ ID NO: 131856 - DNA, 562 bp, Homo sapiens
  Payload ID: 5740
  Gene Symbol: FAM114A2
  Gene Name: family with sequence similarity 114, member A2
  ENST ID: ENST00000522634
  CDS Start-End: 325-562
gtgctgagggtggcggccggatagggacccagaactccatttgacagatgaggaaacggagaggcagacaggtgacctgacttccccacaatcgctgcaggacaggaagaaagtaaactccagagcccgtgctcttagctactaagctgtactgctcttcattttgagacaccaatagtatcttggctttaattgccaaagagctctacatctggaaggaattgaattgagtaacactggtattcaaaagttgatctgacataaagccaatctgatggcttaaatttcatgatgtcctggaaaaattgagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccaga

SEQ ID NO: 131857 - DNA, 1394 bp, Homo sapiens
  Payload ID: 5740
  Gene Symbol: FAM114A2
  Gene Name: family with sequence similarity 114, member A2
  ENST ID: ENST00000520313
  CDS Start-End: 66-1373
aggaacgccgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacct

SEQ ID NO: 131858 - DNA, 571 bp, Homo sapiens
  Payload ID: 5740
  Gene Symbol: FAM114A2
  Gene Name: family with sequence similarity 114, member A2
  ENST ID: ENST00000524246
  CDS Start-End: 526-571
gagtcggctgccgtggctgtgctgagggtggcggccggataggtgcggagcttcctgaacgaggcaggaggggtgcgaggttcaggggcagggcccgggcagccgaagtcgttagggaggcggtgacctgacggtgggcggcggacatctcgcggcagggtcgagggctgtgaaagcggtttagtgattgaagcgctacgtttgtgtgaggaattcttgtcgttgtcagcgcctgagaacttagttgggagcggacgtttacgtcgaatctctcgtttgggaccccattcttgaatgtgggaagaagtgagagcgcatgtttgctcatctagagacagccgtattaataacgataggatacaaaccatcaccccaccaagtgatagcagctgttaacctgtgggcggttacgtgccggtcactgttccaagcccctcacatatcgcgtcactgaatctttatagggacccagaactccatttgacagatgaggaaacggagaggcagacagctgatgttctaatcatgtcagataaagatgatattgagactccactgctaactgaagcag

SEQ ID NO: 131859 - DNA, 609 bp, Homo sapiens
  Payload ID: 5740
  Gene Symbol: FAM114A2
  Gene Name: family with sequence similarity 114, member A2
  ENST ID: ENST00000519808
  CDS Start-End: 233-609
gctgaaggagcacttccggggcagtaggaacgccgagtcggctgccgtggctgtgctgagggtggcggccggatagggacccagaactccatttgacagatgaggaaacggagaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaat

SEQ ID NO: 131860 - DNA, 794 bp, Homo sapiens
  Payload ID: 5740
  Gene Symbol: FAM114A2
  Gene Name: family with sequence similarity 114, member A2
  ENST ID: ENST00000517605
  CDS Start-End: 604-794
atattatatgcccatatattctgaactccatagtgttgtcttaatctacctttctagcttcatgccttcccattgttcttctctctgccatggtaactactccctactgtaactgtccatgttccatactgtcagacctcaggcctttggctgtaccctcatgttatttccatatccttgaatcctgtcattggcatcatcatctgtcaaaatcataagcttcttttaaggcaggtgttgccaactcagatgcctacagaggttaatcaggtagcataatttgagtgaagtggatttgcgtgggggattgtagggagctggagagcaactgccctagctaaaagggcccagcggctatttagcacaagctagttattacagagttgaatgtgggcccggtgttgctagatcttttaattttacaagttagaagttggaagcctatatttttatatgaagtctgatttttaaatgttggcatctagtttttgcaaaggttaaatactgtgcaggccaaataaaaacatctgtaggctggatttggcacttaaattcccagtttgtgaccactactctaggcttatttcagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttc

SEQ ID NO: 131861 - DNA, 754 bp, Homo sapiens
  Payload ID: 5740
  Gene Symbol: FAM114A2
  Gene Name: family with sequence similarity 114, member A2
  ENST ID: ENST00000522395
  CDS Start-End: 125-754
ctgcgctgaaggagcacttccggggcagtaggaacgccgagtcggctgccgtggctgtgctgagggtggcggccggataggtgcggagcttcctgaacgaggcaggagggctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcag

SEQ ID NO: 131862 - DNA, 2121 bp, Homo sapiens
  Payload ID: 5740
  Gene Symbol: FAM114A2
  Gene Name: family with sequence similarity 114, member A2
  Uniprot ID: Q9NRY5
  ENST ID: ENST00000520667
  CDS Start-End: 127-1644
acttccggggcagtaggaacgccgagtcggctgccgtggctgtgctgagggtggcggccggatagggacccagaactccatttgacagatgaggaaacggagaggcagacagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaa

SEQ ID NO: 131863 - DNA, 3379 bp, Homo sapiens
  Payload ID: 5740
  Gene Symbol: FAM114A2
  Gene Name: family with sequence similarity 114, member A2
  Uniprot ID: Q9NRY5
  ENST ID: ENST00000522858
  CDS Start-End: 589-2106
ggccggataggtgcggagcttcctgaacgaggcaggaggggtgcgaggttcaggggcagggcccgggcagccgaagtcgttagggaggcggtgacctgacggtgggcggcggacatctcgcggcagggtcgagggctgtgaaagcggtttagtgattgaagcgctacgtttgtgtgaggaattcttgtcgttgtcagcgcctgagaacttagttgggagcggacgtttacgtcgaatctctcgtttgggaccccattcttgaatgtgggaagaagtgagagcgcatgtttgctcatctagagacagccgtattaataacgataggatacaaaccatcaccccaccaagtgatagcagctgttaacctgtgggcggttacgtgccggtcactgttccaagcccctcacatatcgcgtcactgaatctttatagggacccagaactccatttgacagatgaggaaacggagaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcgtcttcctaaaagctattttggtatccactctttttaaaaaaattctccaactttgtggttttttaatgattaaggtaatttgttagctctgcccctcatcttctaaaacctttgtaataaaatgtattaatcatgttatttgatcctttcatttacttttgtaaacacgagccctaatatcttacttagaccaaaaaaaa

SEQ ID NO: 131864 - DNA, 2044 bp, Homo sapiens
  Payload ID: 5740
  Gene Symbol: FAM114A2
  Gene Name: family with sequence similarity 114, member A2
  ENST ID: ENST00000616320
  CDS Start-End: 58-807
cgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggccttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggcttt

SEQ ID NO: 131865 - DNA, 2365 bp, Homo sapiens
  Payload ID: 5741
  Gene Symbol: FAM117A
  Gene Name: family with sequence similarity 117, member A
  Uniprot ID: Q9C073
  ENST ID: ENST00000240364
  CDS Start-End: 81-1442
cagcagataagcagcggcctcgggggttggggggctgtgtgagtctcgcagtggggctgaggcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 131866 - DNA, 714 bp, Homo sapiens
  Payload ID: 5741
  Gene Symbol: FAM117A
  Gene Name: family with sequence similarity 117, member A
  ENST ID: ENST00000506156
  CDS Start-End: 45-714
gtgtgagtctcgcagtggggctgaggcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtg

SEQ ID NO: 131867 - DNA, 789 bp, Homo sapiens
  Payload ID: 5741
  Gene Symbol: FAM117A
  Gene Name: family with sequence similarity 117, member A
  ENST ID: ENST00000511743
  CDS Start-End: 99-789
ctagcctgcatttctctttccatcctctcgcatatcccagaagaaagaggtacttgaagagtttgcaagagatattagtagtacccgtggcggcctgaatgtggctgttttttcctctctgttaccacccacctacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccc

SEQ ID NO: 131868 - DNA, 1522 bp, Homo sapiens
  Payload ID: 5741
  Gene Symbol: FAM117A
  Gene Name: family with sequence similarity 117, member A
  Uniprot ID: Q9C073
  ENST ID: ENST00000513602
  CDS Start-End: 717-1262
agttcgatccttttggtgaagctagtgggcgccattttgaagttgggcagaaagtgactccagtggtggaacccggagccaaccatttttagttacccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtgg

SEQ ID NO: 131869 - DNA, 776 bp, Homo sapiens
  Payload ID: 5741
  Gene Symbol: FAM117A
  Gene Name: family with sequence similarity 117, member A
  ENST ID: ENST00000503573
  CDS Start-End: 1-168
gcgtcccctcccagcttcccctcagggtcccctgtcttgcgactcagcccctgcctgcacaggagcctggaagggctcaaccaagagctggaggaggtatttgtgaaggagcagggagaagaggagctgctgaggagcccagggcacagaaggtccctgccctcatgaggcttatagtcttatggggacaacacattgatcaagccctacagatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcc

SEQ ID NO: 131870 - DNA, 5763 bp, Homo sapiens
  Payload ID: 5742
  Gene Symbol: FAM117B
  Gene Name: family with sequence similarity 117, member B
  Uniprot ID: Q6P1L5
  ENST ID: ENST00000392238
  CDS Start-End: 1-1770
atgtcccagcgggtgaggcgcaatgggtcccccacgccggccggctcccttgggggtggtgcggtggccacggccgggggacccgggagccgcttgcagcccatgagggcgacggttccgttccagctgaagcagcagcagcagcagcaacatggcagccccacgcggagcggcggcggcggcggcggcaacaacaacggtggctgctgtggtggcgcctcaggccccgcaggcggcggcggcggcggtggcccgcgcaccgcctcgcgcagcaccagccccacgcgcggcggcgggaacgcggccgcgcgcaccagccccacggtggccacgcagacgggcgcgtccgcgacgtccacgcgaggcaccagccccacgcgcagcgccgcgcctggagctcgcgggagccccccacggccgccgccgccgccgccgctgctgggcaccgtgtcgtcgcccagctcgtcgcccacccacctgtggaccggcgaggtgagcgcggccccacccccagcccgcgtccggcatcggaggaggtctccggagcagagccgaagctcgccggagaagaggagccccagcgccccggtttgcaaagcaggtgacaaaacacgacagccttcttcaagcccctccagtattatccgacgcacttcctccctggatactcttgctgcaccgtatcttgctggacactggcctcgggatagccatgggcaagctgcaccttgcatgagggacaaagctacacagacagagagtgcatgggctgaagaatactctgaaaagaagaaagggtctcacaagcgctcagcatcttggggcagtacagatcaacttaaggagattgcaaaattacgccagcagttgcagagaagtaaacacagcagtcggcatcatcgagataaagaaagacagtctccatttcatggcaaccatgcagctattaaccagtgtcaggctcctgttccaaagagtgcacttattcctgtaattcccatcaccaaatcaacaggctcccggttccggaatagcgtggaaggattgaatcaggagattgaaataataattaaagagactggggaaaaggaagagcaacttataccgcaagatattccagatggccatcgtgctccacccccccttgtacagagaagtagcagcacgcgcagcattgacacacagacgcctggtggggcagacaggggaagcaacaacagcagccgttcccagtccgtgtccccaacatcgttcctcaccatttccaatgaaggtagcgaggagagtccttgctcagcggatgacctgcttgttgatcccagagataaagagaatgggaacaattctcctttgcccaaatatgcaacctcaccaaaacctaacaacagttatatgttcaaaagggaacctcctgagggctgtgaaagggtcaaagtctttgaggaatgctcgccaaaacagcttcatgaaatcccagccttttattgtcctgacaaaaacaaggtgaatttcattcctaaaagtggatctgctttctgcctcgtcagcatcctcaagccactccttcctaccccggatcttacactcaagggctctggccacagcctgacagtcaccactggcatgacaaccactctgctgcagcctattgctgtggcctccctgtctacaaacacagagcaagaccgagtctctcgaggaacaagtacagtcatgccatcagcttctctactcccaccaccagaaccaattgaggaagctgaaggataggtcacagtgcaacgtggctgttgttctgggaaattgggaacctcctcagatcactggattctgatggcatcgtgcgcttctggtcggctgtgatgtgctccagctttccagtgacatgtgacggcgaggcttctggaagaaaggatcccccgtgacggctctgccccacttgtgaacgccaaccctcagtgcttagcctgctttttatcaaagcactgattgaaacaagaaaggtctcattctttacctttggagagacaatatcacgtttttgttttcgaattagacttctttaaaacacacacacacacacacacacacacacacacacacacacacacacccctgatccttgccaacatgattcctaaagggagatgtgactgatgctgcaagaaccatcttttctatgaaaatgactattttataatataccaatgttacattttctgaaacgtagcaaacaggatattcaaaagattctttggtggcctctgtttcttgttccctttctagatgtgtgcttttctcagctgttttcagctttgggaccaaagggattgttgacgttttcccagcaatcttaatctcatgactatgttcttctcccaaacaaggattgataggtaaatgcattgaacaagtatatataaaaagagattaaaaagcaatattcgtacattatgtgatttatgtttttgatgtcaaaagtttgtgctttgggtgaaatatttgtataactgctgttttcttcactactcctgtacacatttcaccatgtggtcagaaaagttgtagtctgaagacaagtgctttaatatgttctcacccatattggaacttgatttaaaagtcagtgagccaaaaggaagctatccagcgttgattgctagctaagagtaaggagcccctttggttttctgtgatatatatatatatcacacgctctccctcctttaccacaggtgtcattctacctttaatcatcactgtatcatagccccaaagagatcctgaaatggctgtgcatggatttcctcctttgcccttgtgatgttgttgtcttgtggatttggttgggctagtagtttgccaggagtgtaatccagtggatagtgatccaaactgtagccgcagaatcctgtgactgacatttttctttgtggtggtggttggccctgagatttgttgcctacagattttgctaatttacccccctaacgcttcacatagtggggaaaatacacaagaagaacttgagtatgaacgataagcacctttgaaaactccatacagttttggattagggctcatcctaatataaatcactgccagtatcacatgacatcagtatgtgatttctgggtatgtggtagtgagattaaggagcagcttttttttttttttttttttgagacggagtttcactcttgttgcccaggctggagtgcaatggcgcaatctcggctcactgcgacctctgtctcccaggttcaagcagttctcctgcctcagcctcccaagtagctgggattacaggcatgcaccaccacacccagctaattttgtatttttagtatatatggggtttcaccatgttggtcaggctgttcttgaactcctggcctcaggtgatctgctcgtcttggcctcccaaagtgctgggattacaggtgtgagccaccacgcccatccaggagcagctctttttttaaaagtgagtttcagcaaacagtattgaataaaagcatccttttcatatcttcatatactactttatgatgcaataatttactgttcctatacatattataaggtagaaaaaagtttttaaatccttataaagaggatgcagtttagaaggttaatatgtcagcttacccagacatattctatcaaggaaaacctagtggtagcaataaatctttggaaaggacttcttatactcatgtacctttaaaacatctaagcaatttaaaataatccctgttgagtttaaattcgagatgcatttaggtaaattggataaattcaacatttgaataaatccgtcaggttttagatggtgggattgatgaactttggtactttctcaatccaaaactaatttatttggaactagtacgttatggcttctcagtcatgaaaagctcagttatttggggtctacattttctcactgagagccttgatattttgccttctttgttatgcattataacttgactgtatcaccactgagtatctgctgtatcagaagttcagaagaaaaggtaaaactgaaatcagaatgggggtagaggaagttaaaaacaagttatttaaaaagaactcttggtttttggatgacttgaattctgttaaatctgtgttcttggccttgcacttccgttcctcttccatctctatccctgctagtcacaatggcattttagaactagaatgccactctgtagaggttttcccttttgctctgttgtgcctatttgtctaattcatatctttctgtggagtttcatatgtccttaatctaaagtaacttaaaattggaatggaagaacaagtttcagaattatttacagtcttatacatagaacttctagtgtaatgtttggttgtaaggagaatgtgaatttgcaggtaaatgaattgtatggcaaccagacagatccctggggtttgggagaaatagagcttgagatttgaaaaaaaggtacaaggtacaaaacaactctaactgccagtgccaaagggctaatttttaagcatgtaagctttaccacagtcttgaaaaaaatattaaccataggttcattcagctgttttatttaacccttagttccctggtggttgattttttttttaaatgggtctccagctttccagtgaaatgtgacactctcaatagaatgcataatgttggtttctaaagttacactccataattattgttattctgtagaaaactgtacagaaggtaaatagaatagcttcaatgggaatataatttaaatttttttaattttataaaaatttatttccattgcattaaaagaaatgggtagcatgtgtctttcagagaaaggagctatttggttattcactttgtcaatcttaggtttttttaaatctttaaacaatttcttctttgtgatgataaaaataatataaatttactgtttctgatcatgactgagtctattacttgtcatggcttttgtacgcaactgtgttttaaaaataccggttttgcctctttggttacatgtggtgagcatggatgtcaagattatttttcaactagattattcaatttgttttatatttcttatacttaatacttatgactacagtccaaatcagtcttttagaaggtgctcttgctaactgtggaatatttgacgacatgaaagtcctttttctttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcattttgtttatacagtcttgtttaagaatagaatttttttaactcttcattttttgtctctgtggaagctgtgtaactctttttaaaatgcaatttaaaacattttgttattctaacaattctctcaaaaaacagcatttccaatggtaatcggtattgttacgctgtacttatgtattccctgtacctgaacacttgttgctgcctcacaagaaaatagaacttttatgttaaaaataaagtctgttcttcttga

SEQ ID NO: 131871 - DNA, 3458 bp, Homo sapiens
  Payload ID: 5743
  Gene Symbol: FAM118A
  Gene Name: family with sequence similarity 118, member A
  Uniprot ID: Q9NWS6
  ENST ID: ENST00000216214
  CDS Start-End: 835-1908
aaaagacttcagtggcagacaaaggaggagtaataagatcgctagggggcccgtgcccagcccacccacgcacaatctcagtcctcgcaatacccacaaggtaggtgctaggatcacaccctttacggacgcggcacctgcgacagggatgcgcgaggagtcagggggcctcgccggatcgaacctaagctggggaagagtatttcttgtatttttaggagaaattctcagcctcggggaagagtatttcttgatgagggaagagcgcggggaagacactcacgcacgcacaaacatgtgggcggccatggtgtgcccagcgccgtgctggcttctgggaacccccagtggacaagacggacaaggtaccggctctcaggggaagtgggagccagtcacaagcgtacctaatttcggagagtgacaagtactctgaaaaagaaagaaggtagggctggtgactggccaatttaagcgggcaggagtctgctgggggacggagaccagcctcaggtctgggttggggacagaagctgtgcctaagtgtggtgcaggatgcagttgcaaaggagcgcttccgatcgcacttgatgctcgccacgtccctgcaaagtgctcccgccccctttctgcaaatgaggaaacgggacgcgcggctcgccgggccagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacaggggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttcaa

SEQ ID NO: 131872 - DNA, 1612 bp, Homo sapiens
  Payload ID: 5743
  Gene Symbol: FAM118A
  Gene Name: family with sequence similarity 118, member A
  ENST ID: ENST00000405673
  CDS Start-End: 70-678
ggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacaggggcgccatggtcctgaccaccaactatgacaacctgctggaggcctttggccggcggcagaacaagcccatggagtccctggacttgaaggacaagaccaaggtgtgggctggggctgcgggcagcctgcaggtgtggggagttctgtgccctgggagctgctctcactttgtagcagtgaattactaataaagtagccaggcatggtggcgcctgcctgcagtccccgctactggggaggccgaggtgggaggattgcttgagcccaggagttccagactgaaatgagctatgatcatgccacttattccagcctgggtgacagagtaagaccctttctcttaaaaaaaaaaaagtaataatggaaagtggcacactggcaacttgggaggctgaggcaggagaatagctggaactgggagggagatggttgcagtgagctgagatcactgtactccagcctgggcaagagagtgagaccctgtctcaaaaaacaaaagaaaaaaaaaaagaaatacctgagactgggtaatatataaagaaaagagctgtaattggctcacggttccacagctgtctaggaagcatagcagcatctgcttccggggaggcctcaggaagtttccaatagtggcagaaggcagagtgggagcaggcatgccacatggcaacagagagagtggcaggggggtggtgccacatgcttttaaatgaccagatttctcaagaagtcactgtcacgaagatggcacgaagccatgagggatgatcctgccccgtgatccaagcacctcccaccaggccccacctccagcactggggatcacagttcagcatgagattttcgtggggacaaatgtccagactatatcagttagcatatatttacagttataaataacactacagggtcctcatacttttatgtcctgttttcaagatgaattcctagaagagttttatggtcaaaaggtatgaatgttttaaagactgatgatgtaaattaccaaattgttttccagaaggagcaccagttacactcccggtagtggctgagtgtgggagtatccatttcctgtatcttgccaacacatggtgttattaagaaacaaaatgaaataca

SEQ ID NO: 131873 - DNA, 583 bp, Homo sapiens
  Payload ID: 5743
  Gene Symbol: FAM118A
  Gene Name: family with sequence similarity 118, member A
  ENST ID: ENST00000452238
  CDS Start-End: 495-583
agcttgctgtcctgctgaaacttctaggacctggtgccgagtgcttttgagatcaccttacttggattttggtttaaaaacaagggggagatttagggtaatttctagattattgtgagatttgactctgatgtttaggctgctgtaaaacaggaaatgagagacaggatcttgctgtattgcccaggccggtcttgaactcctgagttcaagcagtccaccttggcctcccaaaatgctgggattacaagcatgagccaccatgcctggtctgattttggaaaaattaaagaatatggagatagcttggtgaaagagacccagatggtttgggatttctgtttttatataagagcagtgtcccaagagacagcgaaaaccccagctcggagcccacagagcccatccttcatctgctcctgtgtgtgcgttttccttctgtgctgtcccgtgtagaacagcgagagtccaaccagcctgatgagtctcatgagatgaggaatggtggcttaggaagcattttggataattcacagatggattcagtggaaaagacaacaaatagaagtgaacaaaaatccag

SEQ ID NO: 131874 - DNA, 549 bp, Homo sapiens
  Payload ID: 5743
  Gene Symbol: FAM118A
  Gene Name: family with sequence similarity 118, member A
  ENST ID: ENST00000424557
  CDS Start-End: 504-549
agtattaaagtctagaggcccatctgcctattgaggttggactccgtgtggttgtgtttgaaatactgtctgaggagccagcaccagacctgcagttcaggctgagaaagaggttttgagcacttaagcgagccacagaccacccaggagtgcgagctgtggcctgttacagacaggatcttgctgtattgcccaggccggtcttgaactcctgagttcaagcagtccaccttggcctcccaaaatgctgggattacaagcatgagccaccatgcctggtctgattttggaaaaattaaagaatatggagatagcttggtgaaagagacccagatggtttgggatttctgtttttatataagagcagtgtcccaagagacagcgaaaaccccagctcggagcccacagagcccatccttcatctgctcctgtgtgtgcgttttccttctgtgctgtcccgtgtagaacagcgagagtccaaccagcctgatgagtctcatgagatgaggaatggtggcttaggaagcattttggataattcacagatgg

SEQ ID NO: 131875 - DNA, 521 bp, Homo sapiens
  Payload ID: 5743
  Gene Symbol: FAM118A
  Gene Name: family with sequence similarity 118, member A
  ENST ID: ENST00000427777
  CDS Start-End: 103-521
gttactgttttctgggatctgattggcttagacggtgtttggatgggagcagaacgctggagcttgctgtcctgctgaaacttctaggacctgaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacag

SEQ ID NO: 131876 - DNA, 1776 bp, Homo sapiens
  Payload ID: 5743
  Gene Symbol: FAM118A
  Gene Name: family with sequence similarity 118, member A
  Uniprot ID: Q9NWS6
  ENST ID: ENST00000441876
  CDS Start-End: 347-1420
cggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacaggggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaaga

SEQ ID NO: 131877 - DNA, 1616 bp, Homo sapiens
  Payload ID: 5744
  Gene Symbol: FAM118B
  Gene Name: family with sequence similarity 118, member B
  ENST ID: ENST00000360194
  CDS Start-End: 66-1118
agtgcggctgcgccggccggtagctgcagctggagcagtggcgtttggaggagactcgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaa

SEQ ID NO: 131878 - DNA, 1028 bp, Homo sapiens
  Payload ID: 5744
  Gene Symbol: FAM118B
  Gene Name: family with sequence similarity 118, member B
  ENST ID: ENST00000529731
  CDS Start-End: 66-893
agtgcggctgcgccggccggtagctgcagctggagcagtggcgtttggaggagactcgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctgtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtag

SEQ ID NO: 131879 - DNA, 2402 bp, Homo sapiens
  Payload ID: 5744
  Gene Symbol: FAM118B
  Gene Name: family with sequence similarity 118, member B
  Uniprot ID: Q9BPY3
  ENST ID: ENST00000533050
  CDS Start-End: 494-1549
actgcctctagggagttctggtccctttggactcaccggctccttctttgtgtcttgttcccgtttctgggctcggagcttctccgctaatctctgggcatttatggccgtagaggcagcggcagcggcacaaaatggctttgagacgagagtgaagagactcccgcaaccttggccgtttccccggatccaggggcccgacgcgctccacctgggcgccgccatcttacaaggaagggcggggcgagccaagaccacgtggagaagggcgactacaatgaggcgggagtgggtgggccctgcaggtcacgtggtgcggggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaccctggctctacttttagagtcattgtaagaaactctaacttgcatcaaggtactaataagcttaattttaataacccaaagtttaaaggttccgatctttctccttggggtggagtgatctcattctcaggacaaccgtttacttacctgattcctcggagcattatcaacttctgctctgttgtcctgaccatacatatgtcctagaactacagttaagtgtgttgtggaattttagttttgaatcctgtataaaagaactccaagacctaaaaggcaatttatttatgaaatttattttcttatataaattacttatttctctgggc

SEQ ID NO: 131880 - DNA, 1311 bp, Homo sapiens
  Payload ID: 5744
  Gene Symbol: FAM118B
  Gene Name: family with sequence similarity 118, member B
  ENST ID: ENST00000528985
  CDS Start-End: 272-1311
cagtgcggctgcgccggccggtagctgcagctggagcagtggcgtttggaggagactcggatataccttctcagaagctgcacaggaggaaagcagtgacaaagaaagaagttgtcattctttgcacgctttctcaccaacagaatcaaagatttgactggaaacatgatctacttcctaactcactactgtgactgtattatttctatttaccttatgattatgatataaagaagaattacactgcgtgtgatggactatgggaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagggatggtgagagaaggtcagctaaatggctcatctgcagcacacagtgaaataagagg

SEQ ID NO: 131881 - DNA, 784 bp, Homo sapiens
  Payload ID: 5744
  Gene Symbol: FAM118B
  Gene Name: family with sequence similarity 118, member B
  ENST ID: ENST00000525338
  CDS Start-End: 78-784
ggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctgtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccaga

SEQ ID NO: 131882 - DNA, 632 bp, Homo sapiens
  Payload ID: 5744
  Gene Symbol: FAM118B
  Gene Name: family with sequence similarity 118, member B
  ENST ID: ENST00000530043
  CDS Start-End: 174-632
cggctgcgccggccggtagctgcagctggagcagtggcgtttggaggagactcggatataccttctcagaagctgcacaggaggaaagcagtgacaaagaaagaagttgtcattctttgcacggtaaaatcatcacctccagtcaccaacttctaattcaaattagaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatg

SEQ ID NO: 131883 - DNA, 1862 bp, Homo sapiens
  Payload ID: 5744
  Gene Symbol: FAM118B
  Gene Name: family with sequence similarity 118, member B
  ENST ID: ENST00000627851
  CDS Start-End: 184-1011
gtggtgcggggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctgtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaccctggctctacttttagagtcattgtaagaaactctaacttgcatcaaggtactaataagcttaattttaataacccaaagtttaaaggttccgatctttctccttggggtggagtgatctcattctcaggacaaccgtttacttacctgattcctcggagcattatcaacttctgctctgttgtcctgaccatacatatgtcctagaactacagttaagtgtgttgtggaattttagttttgaatcctgtataaaagaactccaagacctaaaaggcaatttatttatgaaatttattttcttatataaattacttatttctctgg

SEQ ID NO: 131884 - DNA, 5118 bp, Homo sapiens
  Payload ID: 5745
  Gene Symbol: FAM120A
  Gene Name: family with sequence similarity 120A
  Uniprot ID: Q9NZB2
  ENST ID: ENST00000277165
  CDS Start-End: 195-3551
gtccctccccagacatggccctgggaggcggcagcacatggcggccgcggcggccatgagcgcgcccccgacccgccccagtcccccctagaggccgccgcccccgcccgccagcccgcccgcgcgccacggccccaccacccccggccccgccgccccccgcccgcacccgcgcccgcgcccccgccgccgccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctttagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagt

SEQ ID NO: 131885 - DNA, 3585 bp, Homo sapiens
  Payload ID: 5745
  Gene Symbol: FAM120A
  Gene Name: family with sequence similarity 120A
  Uniprot ID: Q9NZB2
  ENST ID: ENST00000375389
  CDS Start-End: 26-1912
ccgcgcccgcgcccccgccgccgccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaaggtattatcaaaggggccctggagtggcttctgttatttgatgagtggccattcctatgggtgttttgtccttttgtccttttttgaaccatttttctgtcttactaatctacttgaaacaaagttcactttcccctttctaaacattgaatgaaagatgaacatttataactgtaaatagttttaaaataactcgtgaaaagtctcacttttttccttcaacttagtatagaatattttatacttctaatgaaataatgcatcacattattttatgacttgtaattttattctttttacttcaatttcagaattttcttaaaccatatttgtgctgtaatgtcaggtttaattctgatgtcagatacaatatctggttcctttatcatttgtgcttagaaaataatgtttccccctttgaatggctcatagtgcttcatgtgttttgacttgttcatgacctcattgagtgcagttttaatagtgctaagaacaaaaaatataatacaggattttgttaacatacgcatagtcagaaaatgaaactatcattttatacagtgtcataatttcactttattagtgtcttaatgtatgcttaaatatatacatatagtgtggcatcaattattttttaatcttggtgtctcaaatgtatctatgtgtatttaaatttcctcagtgatttgtagtctttatgttggcacttttaatcttagccccacaatttaacaagttacctcagttactagattaatcctgcagaactggtttattgctatcatgtattattaacatgaatacctatatgaccatatataaccagacttttctgtctattctctacaacccatctgtggtttgtaaaatggagtcaataaatgcaataatgaactcctgttctcaaatactcctgaggtggacttcaactgttaactgactaatccaaatattgcttacttttattaattaaaggacatggaaaacatgtagccagtactatttgctcagatcctttaatttattttttagttgtaatgcctccaaatctcatctattatttgatatgggtatgcatttatagtatcacttttcagattatggttgtaaggtgaacattttatttttcaggttcaacataaattataaagggtaagtgaaaagtaattgttgtggggaaaacattttgctaagtttaaggaaccaaagttttgggaagacatctttcaaaataaggtgtgaagaaacaacactcattcctcgtggggctgtttgaaatgtaaggtccccaggagctacctgttatgtccacactgctggatctgatgcgtggatagtcggttagatctatatgagggttgcaaattgtaccgacatgctttcttatttcttatgaatttcaagggcaaatactgataaaatgaccatggttgagaaaattgtcttttcacattttaaaatgctacttaagttttttcagtttatcctataagctgaatggctctggtattaattgcccaggctaagacatttacagtgagatgcatctttatggtaatgaagagaatttgcaaagcatcatattattgagataaatattccctagatgagagtgttagaacacatgtagctactggattaatgaatatgaaagtatggagggtaaggggaaagaccagtttttaaattaaacttatgtgaatgaaagaaacagcaaatattacaaaattattatttaaagcatatatatcaatgaacttcatagacattgaggtcataaatgcattgttgtgctctgagtataattaaataaaatttgttgcatga

SEQ ID NO: 131886 - DNA, 1701 bp, Homo sapiens
  Payload ID: 5745
  Gene Symbol: FAM120A
  Gene Name: family with sequence similarity 120A
  ENST ID: ENST00000446420
  CDS Start-End: 1-1488
gtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaatgtatgtactgtaacaatccattgtttgttttcctcggtacctcgtaatctcttgtgcattttctaaagccttagaagaatcatgactgagttgaccccgagtgcctctgtgtaaaggaggtgggcccatcatcggggcagtaggccagggtaaaggctcttagaaaaggaggagaagccacagactttcttcctcagtaacattccaataatgatgtttattcagtaaaataataaaacaggtttacactttaaagtgaa

SEQ ID NO: 131887 - DNA, 1710 bp, Homo sapiens
  Payload ID: 5745
  Gene Symbol: FAM120A
  Gene Name: family with sequence similarity 120A
  ENST ID: ENST00000427765
  CDS Start-End: 1-1485
ggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaa

SEQ ID NO: 131888 - DNA, 2771 bp, Homo sapiens
  Payload ID: 5746
  Gene Symbol: FAM120AOS
  Gene Name: family with sequence similarity 120A opposite strand
  Uniprot ID: Q5T036
  ENST ID: ENST00000375412
  CDS Start-End: 884-1654
gctatcattttaggcttaactaccaccatctcctcgcgggcagtgggggcaaccgcgaagacagaatttcacaaactttcagctccagcagtttcaaggaaatgtcaaatgacaagatggaagaccgagtgtcaagagctaagacaacaaaaaggcccccaaaatttgttttcaagaaaaccaatgaaaaaagcaagcaatcagaacgtgaagtccaggatcatggatgtgcttatcttcacagtcactgctgggtcctgaagttctcctctggcccagtgccagctgcgaagccctctgccaaagggccagaggaggccggtgatatagagctctgattacccacccgtcagggcaccgctgaaggtcactgaatacttactgtgcacccgaaaaataaatcctgcgagttcacgcccgcgtagttcgccccctgattttgagcgactcctttcgcatgggatctacaaaaccgaactgccttaaagacctctttcacacggacgtgaagtcacagaactgacaaaatcccatcctgtcaaagtgcacgggtctttgaaatctaacacaaaaagccatagaaagattctctaaacaccctgtactaagaggaacacggacagggcactgcgttctgaagtagaggccagggcactggcccttagacacgtctcgctgtcaccgggctaacaacattggcaagggcggcggcagcagcactgatatttgcagcccccaagggctctggcgaaaccccctctattactctgtatcctgcctgcttccaagatgaacctgttgctgggaaagaacaggctaaattagaaaagggagtattttgtcaaagttgaaggtgagtgatagcctgcccgcctcaaataggatgggaaaaactaaggatattggggatgatgacactgtcgcctccgaattctggtccggggctctctcccagccctcaagtgtccccacgcggccgcggaccccgaacagggacagctggagacgggcttgggcagcgcgcggcctgcacccgcggccatccatcttgcagcccggcccggccaggctatcccgggcaagggctgggggaactcgctgcccccagcgccgccacggccgggcgacattctgcgccctgggaagggggataggggtgcggcgcggccccggtccccggcccgcccggatccccggcctcaccttgacgtggaagcggatgagcgccaggcggatgcagtgggccatgcagacgggcggcaggaaccagacctttggcggcggggtgcccttgttctggacatggctgacgatctgctgtgccgtctggcgctcgttgccctgccgcttgacccactcgtgcagccgggccttctcgagcgcgccgttgaagaagacgaagagctcgatgttgccgccgaagcaggccttggccagcgccgccagaaacctctgtagaggagcaggatgcaaccgacaggctgtggccggacagctgctgcccagcacatggagcctgcacgcgcacggtttggccaaagaagcccccatactcccggtgaaaaagatttccagaagctgttctgtcaataacaaagtctcaaagaaaaccacaaaaccaccaacactaagatcattcttgagtccaatttgaaaaactagggtcaagttctgcagaggcattgaaaggacaagaaaccaccctgatacccatcgtgtgagggaaaatgctctattcaccattcctcagcttctgcttctggtttcagagttctctctatattggagggtgttttaaagctagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctactggggatatggagatgaagaaaacataacccttcttcaaggagcccaacctaccaaggtagacagacatatagacaaatagatacttgcatagaaaaaaagaggaaaaggggatcagtgtgacctgtgtaactaagtaccctataaaccctcctgcaacagatcatattgccctttatagtggggatggtaatcccatctgaattccacaggtactttgcagtcataccacacccatgtgtctgtcggtcctgactgtaccatttataaacagcttcactttcagcagttctcagccctcttaagctagggtcattgtcagtagggatactgcttcataagcaccagcagaacaccaaaggagaccatatgggtgaaagcaaccagcactgccctggcgcttcataggttcttagagtttttatcttttactttcagtctaacacagcactgcctgctttttgtttttgttgcttggtttgtttttttcttaccgtgttcaccaaacttgtgtccaaatagctttgggctgatgcaaaaatatctatgtggaagagaagagttgttctcatggagggccttcagatgagtgctatagactctctaggcaactccaagaggcttctcaagcagggtgggcagtgagagctgctatggaatcaatggacaaactgacagggactgctttgaaagacagtactcagttgagtatatatattctctcttaagggctaaaagtttataatcatcccttaaacactctgtgatgggatcttcaggatcatcttttgaagtaaactatattttacaatgtgatataaa

SEQ ID NO: 131889 - DNA, 1800 bp, Homo sapiens
  Payload ID: 5746
  Gene Symbol: FAM120AOS
  Gene Name: family with sequence similarity 120A opposite strand
  ENST ID: ENST00000423591
  CDS Start-End: 459-683
cgcggctcggggctcccggaggcggcggcggaggcggaggcccggagttgggccgggacgggatccgggaggcttctgagccggagcaggcagcgcctggaggccagaggccgttcgcccgcctcaggccggtcggccgccgctcccctcccctgcgccctgttcccggcagggccagagaggccgccgcctccgcccggtggttctcgggcgaagggaagccgcgaagcaggtcctggggaagagctcgcctgctcctgagggaagcagcgataagatggcgctttgaaggggagccgaggccgagtcactctgttcgtcgggacgccgcctttctaacgccgccgtcggctcgcaccactctgggcctgctgcccacactgactgcggggtccgggagagcgggatgctggccggccgcgcctggcttcttggaaagagcaggaaggagcgcgagaatgcagttccgcggcagaaacctctgtagaggagcaggatgcaaccgacaggctgtggccggacagctgctgcccagcacatggagcctgcacgcgcacggtttggccaaagaagcccccatactcccggtgaaaaagatttccagaagctgttctgtcaataacaaagtctcaaagaaaaccacaaaaccaccaacactaagatcattcttgagtccaatttgaaaaactagggtcaagttctgcagaggcattgaaaggacaagaaaccaccctgatacccatcgtgtgagggaaaatgctctattcaccattcctcagcttctgcttctggtttcagagttctctctatattggagggtgttttaaagctagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctactggggatatggagatgaagaaaacataacccttcttcaaggagcccaacctaccaaggtagacagacatatagacaaatagatacttgcatagaaaaaaagaggaaaaggggatcagtgtgacctgtgtaactaagtaccctataaaccctcctgcaacagatcatattgccctttatagtggggatggtaatcccatctgaattccacaggtactttgcagtcataccacacccatgtgtctgtcggtcctgactgtaccatttataaacagcttcactttcagcagttctcagccctcttaagctagggtcattgtcagtagggatactgcttcataagcaccagcagaacaccaaaggagaccatatgggtgaaagcaaccagcactgccctggcgcttcataggttcttagagtttttatcttttactttcagtctaacacagcactgcctgctttttgtttttgttgcttggtttgtttttttcttaccgtgttcaccaaacttgtgtccaaatagctttgggctgatgcaaaaatatctatgtggaagagaagagttgttctcatggagggccttcagatgagtgctatagactctctaggcaactccaagaggcttctcaagcagggtgggcagtgagagctgctatggaatcaatggacaaactgacagggactgctttgaaagacagtactcagttgagtatatatattctctcttaagggctaaaagtttataatcatcccttaaacactctgtgatgggatcttcaggatcatcttttgaagtaaactatattttacaatgtgatataaa

SEQ ID NO: 131890 - DNA, 426 bp, Homo sapiens
  Payload ID: 5746
  Gene Symbol: FAM120AOS
  Gene Name: family with sequence similarity 120A opposite strand
  ENST ID: ENST00000428378
  CDS Start-End: 229-426
cgcctgctcgtcacggaagagactgtcttgagagcacaggtctgttgcagcgtgggaaagcctgcgttaccactgcgcaatggctagactgaaacgtgcgcctttgcagtggatctcccagctcttctgagggagagggatttgaatcttgttgctttagtagcatcttctggaaggaggtcgtttacgtaaattctgttccaaagctctgtcgtaactgcttctaaaatgaggttgatactaaacctctgtagaggagcaggatgcaaccgacaggctgtggccggacagctgctgcccagcacatggagcctgcacgcgcacggtttggccaaagaagcccccatactcccggtgaaaaagatttccagaagctgttctgtcaataacaaagtctcaaagaaaaccacaaaaccaccaacacta

SEQ ID NO: 131891 - DNA, 1491 bp, Homo sapiens
  Payload ID: 5746
  Gene Symbol: FAM120AOS
  Gene Name: family with sequence similarity 120A opposite strand
  ENST ID: ENST00000476484
  CDS Start-End: 459-635
cgcggctcggggctcccggaggcggcggcggaggcggaggcccggagttgggccgggacgggatccgggaggcttctgagccggagcaggcagcgcctggaggccagaggccgttcgcccgcctcaggccggtcggccgccgctcccctcccctgcgccctgttcccggcagggccagagaggccgccgcctccgcccggtggttctcgggcgaagggaagccgcgaagcaggtcctggggaagagctcgcctgctcctgagggaagcagcgataagatggcgctttgaaggggagccgaggccgagtcactctgttcgtcgggacgccgcctttctaacgccgccgtcggctcgcaccactctgggcctgctgcccacactgactgcggggtccgggagagcgggatgctggccggccgcgcctggcttcttggaaagagcaggaaggagcgcgagaatgcagttccgcggcagaaacctctgtagaggagcaggatgcaaccgacaggctgtggccggacagctgctgcccagcacatggagcctgcacgcgcacggtttggccaaagaagcccccatactcccggtgaaaaagatggagtcttgctctgttgcccaggctggagtacaatgatgtgttctcagctcactgcaacctccctctcccaggttcaagtgatctcctgcctcagcctctggagtagctgggattacagatttccagaagctgttctgtcaataacaaagtctcaaagaaaaccacaaaaccaccaacactaagatcattcttgagtccaatttgaaaaactagggtcaagttctgcagaggcattgaaaggacaagaaaccaccctgatacccatcgtgtgagggaaaatgctctattcaccattcctcagcttctgcttctggtttcagagttctctctatattggagggtgttttaaagctagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctactggggatatggagatgaagaaaacataacccttcttcaaggagcccaacctaccaaggtagacagacatatagacaaatagatacttgcatagaaaaaaagaggaaaaggggatcagtgtgacctgtgtaactaagtaccctataaaccctcctgcaacagatcatattgccctttatagtggggatggtaatcccatctgaattccacaggtactttgcagtcataccacacccatgtgtctgtcggtcctgactgtaccatttataaacagcttcactttcagcagttctcagccctcttaagctagggtcattgtcagtagggatactgcttcataagcaccagcagaacaccaaaggagaccatatgggtgaaagcaaccagcactg

SEQ ID NO: 131892 - DNA, 5155 bp, Homo sapiens
  Payload ID: 5747
  Gene Symbol: FAM120B
  Gene Name: family with sequence similarity 120B
  Uniprot ID: Q96EK7
  ENST ID: ENST00000476287
  CDS Start-End: 109-2841
gtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccttggctttttcctctacgtacataccatgataaagcttaacaaagaacagtgagagattaacagcaaccaataactaataaaagctatgtgaatgtggtctctgtcaaaatatcgtgctgtaatcacccttcttgctatctgaaaaccaagaagaccactaagtgactaatggtcagagaagctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttccaactatgtgttctcttggtcctcagaagtgtttgaatagaaaagtaacaactaacttcccatctttctggtggaagagttaattctgcctggagggttctgcctgggagacatgacagcatgtgtgtgactcctgtgtctgtttctgtggggtcatccctttcgtttcattttgccagggcctggctcaggattttttatggcagtgcctgtgaagacaagcctggccctccatccagtcacacaggaaatccacagagagcatgctgagagcagccagcggctgggctgccatcaggcctggtttatgatgccacaagtgaatggcacgtttgttcctctttatctctgagcattgaaggacttttggttaaaaaaaaaaattaagttcagagtaatccttttcatggaagaatcttcaggtcaccaaagaattgaaattttaagccccagattgtactgagctgtacctgtgggaaaaggaatggccagggtattgatgatggaaaagattcaaatgaggagttagaaggcaagccctctgtgggcagccgtcttccagaaacctcgaacttatgtctgtctccacctgagaaaggagaagaaaagctggtggtgacccctgctcctgctgggccatgccatggctctgaagatgccccgtgttcttaggaggtgctcacccctggcacctaaagacatttccttctggttgttgctctttaaaaacaaaataagcccctgaacgtgcttgcaggccagtttgtgtgcctgcacttgacgaattaccttgaccaacgggccaaaggcacagagctccaaggcatcatctttccttaaaatcctgagtgtttattaaaaagggacatggtctctaggtatcttattacatttgtatttcttacatttgaaatatcctaaccgctcccttcggtttcttcttaagaacatttacatctaattatttttcgtgcaagtcttgtaggacccacatgttttcctagctttggaaatcgatttttttcattcctcttatgaggatttccctatgtcagtaaacattaactttctatttcttccatttttgctcatttgaaacccctgctgcttctagatctatttctttgcacttgtataactttgaaataaattcctcatcccttagactaagagagtgggtgtctgtgaaaattgttttctccttcataatacctaaattctagtttgtcagtaaaatatttgtgtttggttaacaagctcttatttaagccattgagttagtataatctttattacctttgaaaaaccagagagctgaattttttgtcattctaagttgtaagtaacactgcagtcaagtcttctgatgaaatttccatatatcaaattgaaaataaagcaaaatatatttattactcataact

SEQ ID NO: 131893 - DNA, 3212 bp, Homo sapiens
  Payload ID: 5747
  Gene Symbol: FAM120B
  Gene Name: family with sequence similarity 120B
  ENST ID: ENST00000537664
  CDS Start-End: 86-2887
actcggttgccgcgcgtggacttacaagcccacgaagccatcgttcgtcacagcctggaaaagggagggggcatcgatctggtttatgtttggacctcgaggctccaccagcgctggcgcaggcaggaaggagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttg

SEQ ID NO: 131894 - DNA, 3721 bp, Homo sapiens
  Payload ID: 5747
  Gene Symbol: FAM120B
  Gene Name: family with sequence similarity 120B
  ENST ID: ENST00000619268
  CDS Start-End: 356-3124
gtcactcggcggcggcggtcgttccgggagcactccgggctccgatctccggtgtcacagcaaagatccgcgtctttccgatgaatccagccaatgccatccagtacacacgcgcaggaccggaggggccgggccgtgggaggaggctctgcgccgcggctgcccgggttcccctgcgctctgccctcggccgggtcgggtctccgcgggtgcgcgcagaggatctggctctcgccggcgcctgccgcccttatattcagccggccgcccgcatggctaatgagatgcaaatcagcagccccccaatctggcgagagctgtcacaaaggagccacttttccaaaccctcctctcaatggatcgccaaatgatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccttggctttttcctctacgtacataccatgataaagcttaacaaagaacagtgagagattaacagcaaccaataactaataaaagctatgtgaatgtggtctctgtc

SEQ ID NO: 131895 - DNA, 3212 bp, Homo sapiens; identical to SEQ ID NO: 131893
  Payload ID: 5747
  Gene Symbol: FAM120B
  Gene Name: family with sequence similarity 120B
  ENST ID: ENST00000622189
  CDS Start-End: 86-2887

SEQ ID NO: 131896 - DNA, 5155 bp, Homo sapiens; identical to SEQ ID NO: 131892
  Payload ID: 5747
  Gene Symbol: FAM120B
  Gene Name: family with sequence similarity 120B
  Uniprot ID: Q96EK7
  ENST ID: ENST00000617082
  CDS Start-End: 109-2841

SEQ ID NO: 131897 - DNA, 1794 bp, Homo sapiens
  Payload ID: 5747
  Gene Symbol: FAM120B
  Gene Name: family with sequence similarity 120B
  Uniprot ID: Q96EK7
  ENST ID: ENST00000616072
  CDS Start-End: 175-903
gaacgaggcggctgtggcggtggctgaggcggctgggcctagggtgcagcgggcgcgtctgcggctggtgttggcgcatctctagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactatacagtagtcctcccttatctgcgggggagacatcccaagaccctcagtggatgcctgagactggatagtatggaatcctacatatctataccttggctttttcctctacgtacataccatgataaagcttaacaaagaacagtgagagattaacagcaaccaataactaataaaagctatgtgaatgtggtctctgtcaaaatatcgtgctgtaatcacccttcttgctatctgaaaaccaagaagaccactaagtgactaatggtcagagaagctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttcc

SEQ ID NO: 131898 - DNA, 3721 bp, Homo sapiens; identical to SEQ ID NO: 131894
  Payload ID: 5747
  Gene Symbol: FAM120B
  Gene Name: family with sequence similarity 120B
  ENST ID: ENST00000630384
  CDS Start-End: 356-3124

SEQ ID NO: 131899 - DNA, 1794 bp, Homo sapiens; identical to SEQ ID NO: 131897
  Payload ID: 5747
  Gene Symbol: FAM120B
  Gene Name: family with sequence similarity 120B
  Uniprot ID: Q96EK7
  ENST ID: ENST00000625626
  CDS Start-End: 175-903

SEQ ID NO: 131900 - DNA, 3716 bp, Homo sapiens
  Payload ID: 5748
  Gene Symbol: FAM120C
  Gene Name: family with sequence similarity 120C
  ENST ID: ENST00000328235
  CDS Start-End: 58-2745
cagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgactcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaaggtctttcagagccttgaagaccaccatttggaagtggtggcgtttttcagggaaaatggcttccatggccttcttgcccatgactccgagtatgctctctacaatattccctcttactacagttcccatgctctgaaactgagctggaatgggaagaacctcactaccaaccagttcctgatgcaagaagtagccaagcagctgggcctgaagaggatgaatttccccatatttgctgcactgctaggtaaccacatcctcccagatgaggacctggctgcttttcactggagcctcttgggaccagaacatcctcttgcatcacttaaggttcgagctcatcagctggttcttcctccctgtgacgtggtgatcaaggctgtttctgagtatgtcagttccatcaaagatccctcaaacctggatgtagttgggaaggatgttttcaaacagtctcagtccaggacagaagataaaatagagcgattcaagaaagcagttgagtattattcagtcacaaccaaactctcttcgctgccagtgggtccctcctttctaggttttcggaataataggcttggaaatcctccccttccacgaaatcaagtgggcaccatttctgctggaaagccaatgttttctcatcaagtgccccagaaagtgaaatatccaccaccattcccagtgggacccaactcatctcttctcttctcctcccatgctttgggggaatcccatgctttttctgaggatcccatgctgcagaacagcccctttgccaattgggctgtctcctatgactcttctgcatcccagtttcccaattacctgccttctaaagcctcacctcctttgggaccagactcttcccactcctcttcctctgatggtgatgagccaaatggagctagctctgatcatatcacagaagcatttcatcaccagcctgagtggggaaatcccaatcgtgacagagggtcctgggcacagcctgttgatactggagtttcagaagcgagcctaggtgatggtgagccccacatcccatctctgctgtctatgtctacaaggaaccacatggatatcaccattccacccttacctccagtagctccagaagtcttgagagttgctgaacacagacaccggaggggtcttatgtacccatatatctaccatgtcctcactaagggtgaaattaagatccccgtatgtattgaggatgagtgtaacatggagctgcctccagctgctctcttattccggtcagctcgtcaatatgtatatggagttctttttagtctggcagagacacagaggaaaatggaacgcttggccatgcgacggcggctgcctgtggaagttccttcagtgatccttaaagagtggtctgcctataaagggaagtcacctcaaacccctgagctggtgtctgcactgacatttcgggaatggacttgcccaaacctcaagaagctctggctaggcaaagcagttgaagacaagaacagaaggatgcgggccttcctggcctgtatgaagtcggacacgcccagtatgctcaatccagctaatgtccccacccatctgctgctcatgtgttgtgtactccggtacatggttcagtggcctggtggccgaatcctgcatcgccatgagctagacaccttccttgcacaggcagtgtctacccagctttatgaaccagatcgactccaagaactcaaggtctccatccaatcccaccccaaggaggaaaactggagattgctgggatggttgtgggccagtgggctggcagcagatcctccaggggccgaggatccttcggcatgcaagtggtttctgtcggtgggccaggaaaggggcatggaaaagaacagactggtagaggatccaagggacacaaaaaaggaaataagcaaggctcttcagatggagtttctaaatccctggagcttcatcaaggtcggtctcgctcccaggtaaatggaaacagtggcgcattgatcaaggaagagaagagtgatcatcgtcttccagctccatcacaatgtgccttatccagagacagcaatgagtgtaataatggtaaccgctacctccctatgaataatagggagaagaaccacttacaagagcaaaagctagaaactgtggcacaacggaaagaggactgataagctgaagatggcttcaccaaaccaggaagagggaaaaacttttacttttctgattttaggcccaagctagaggaggatataaatgcttaccctagatttctccaggattttggtgggatgtcctattgtgtccatcttttccccttccctgcctgtttctgggacttcagattcagtggtctgtttctggagaagttctggtcaaagatgaatggcagtaagactaggtcctagtctcaaattgaagatatagcaccaatagtttatttatctcctctgggagcctagtaaggcagtagctgtcagaaattgggtatcatcacataaggtcctatagaaaagctctagctttggtttttctgagcatttataatgatactcattatcaaagacttatatgataaacctatgaggttgtggggacagctgtggcctcctgaggtttttttttgttttttttttttctctatgaagtggtatctacctcttcttcactccttccaacttacctacccctggattttgtaccaccacctctagctttggcctgacaatcagataggtagatgttttcagaaaagtaaggtagtattggttattttaatttttattttttattttatacacttcaaaaaaactatcaatggcctttgtactgggggattcaagtgaatcagaaaagtactgggcagatttttcctgcctctcaaccagtgcattgtttgtaaaatagaagatgtggcacagttcattcactccctattgcccacaccatga

SEQ ID NO: 131901 - DNA, 8057 bp, Homo sapiens
  Payload ID: 5748
  Gene Symbol: FAM120C
  Gene Name: family with sequence similarity 120C
  Uniprot ID: Q9NX05
  ENST ID: ENST00000375180
  CDS Start-End: 58-3348
cagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgactcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaaggtctttcagagccttgaagaccaccatttggaagtggtggcgtttttcagggaaaatggcttccatggccttcttgcccatgactccgagtatgctctctacaatattccctcttactacagttcccatgctctgaaactgagctggaatgggaagaacctcactaccaaccagttcctgatgcaagaagtagccaagcagctgggcctgaagaggatgaatttccccatatttgctgcactgctaggtaaccacatcctcccagatgaggacctggctgcttttcactggagcctcttgggaccagaacatcctcttgcatcacttaaggttcgagctcatcagctggttcttcctccctgtgacgtggtgatcaaggctgtttctgagtatgtcagttccatcaaagatccctcaaacctggatgtagttgggaaggatgttttcaaacagtctcagtccaggacagaagataaaatagagcgattcaagaaagcagttgagtattattcagtcacaaccaaactctcttcgctgccagtgggtccctcctttctaggttttcggaataataggcttggaaatcctccccttccacgaaatcaagtgggcaccatttctgctggaaagccaatgttttctcatcaagtgccccagaaagtgaaatatccaccaccattcccagtgggacccaactcatctcttctcttctcctcccatgctttgggggaatcccatgctttttctgaggatcccatgctgcagaacagcccctttgccaattgggctgtctcctatgactcttctgcatcccagtttcccaattacctgccttctaaagcctcacctcctttgggaccagactcttcccactcctcttcctctgatggtgatgagccaaatggagctagctctgatcatatcacagaagcatttcatcaccagcctgagtggggaaatcccaatcgtgacagagggtcctgggcacagcctgttgatactggagtttcagaagcgagcctaggtgatggtgagccccacatcccatctctgctgtctatgtctacaaggaaccacatggatatcaccattccacccttacctccagtagctccagaagtcttgagagttgctgaacacagacaccggaggggtcttatgtacccatatatctaccatgtcctcactaagggtgaaattaagatccccgtatgtattgaggatgagtgtaacatggagctgcctccagctgctctcttattccggtcagctcgtcaatatgtatatggagttctttttagtctggcagagacacagaggaaaatggaacgcttggccatgcgacggcggctgcctgtggaagttccttcagtgatccttaaagagtggtctgcctataaagggaagtcacctcaaacccctgagctggtgtctgcactgacatttcgggaatggacttgcccaaacctcaagaagctctggctaggcaaagcagttgaagacaagaacagaaggatgcgggccttcctggcctgtatgaagtcggacacgcccagtatgctcaatccagctaatgtccccacccatctgctgctcatgtgttgtgtactccggtacatggttcagtggcctggtggccgaatcctgcatcgccatgagctagacaccttccttgcacaggcagtgtctacccagctttatgaaccagatcgactccaagaactcaagattgagaaactggatgcccgagggatccagcttgctgccctcttcatgagtggagtcgacacagctctgtttgctaatgatgcctgtggccagccagtcccttgggagcattgctgtccatggatttactttgatggcaagctgttccagagcaagctaattaaagcaggccgagagcgagtatctctggttgagctctgtgatggccaggctgacctggcaaccaaagtggaaaagatgagacagagcatccttgaaggagtcaacatgaatcatccaccgccttctgctctacttccgtcacctacttttgtgcctcccatggtgccctctctctaccctgtttcactttattcccgagctatgggctccatgccacttccccctcaagggaggagccggggatttgcaggtctccatccaatcccaccccaaggaggaaaactggagattgctgggatggttgtgggccagtgggctggcagcagatcctccaggggccgaggatccttcggcatgcaagtggtttctgtcggtgggccaggaaaggggcatggaaaagaacagactggtagaggatccaagggacacaaaaaaggaaataagcaaggctcttcagatggagtttctaaatccctggagcttcatcaaggtcggtctcgctcccaggtaaatggaaacagtggcgcattgatcaaggaagagaagagtgatcatcgtcttccagctccatcacaatgtgccttatccagagacagcaatgagtgtaataatggtaaccgctacctccctatgaataatagggagaagaaccacttacaagagcaaaagctagaaactgtggcacaacggaaagaggactgataagctgaagatggcttcaccaaaccaggaagagggaaaaacttttacttttctgattttaggcccaagctagaggaggatataaatgcttaccctagatttctccaggattttggtgggatgtcctattgtgtccatcttttccccttccctgcctgtttctgggacttcagattcagtggtctgtttctggagaagttctggtcaaagatgaatggcagtaagactaggtcctagtctcaaattgaagatatagcaccaatagtttatttatctcctctgggagcctagtaaggcagtagctgtcagaaattgggtatcatcacataaggtcctatagaaaagctctagctttggtttttctgagcatttataatgatactcattatcaaagacttatatgataaacctatgaggttgtggggacagctgtggcctcctgaggtttttttttgttttttttttttctctatgaagtggtatctacctcttcttcactccttccaacttacctacccctggattttgtaccaccacctctagctttggcctgacaatcagataggtagatgttttcagaaaagtaaggtagtattggttattttaatttttattttttattttatacacttcaaaaaaactatcaatggcctttgtactgggggattcaagtgaatcagaaaagtactgggcagatttttcctgcctctcaaccagtgcattgtttgtaaaatagaagatgtggcacagttcattcactccctattgcccacaccatgaaagggtgggaatcagtgtaatgaacttgagtacgaaagggactcaagagactgtgtgtgtgtgtgtgtgtgtgtgtgtgtgtgtgtgtgtgtgaatgtgtgcttgtgtgtgggtgtgggtggatgttgtgtgggtgggtgtatatatgaatgtgtgtatatgcatacacataccctttatataaagagacagatctatttatctatacatattttatatatatgtaagtgtgtgtgtatgtgtgtatatatgtgtgtatatatatatacacacatatatacacacatacatacatacatacatacatacatacatacatggtgatgtcccagaggatttactcaatttcccagaaatgcttccactgctatggagtggaaggtttcaaaagaccacacttttaatctgaaattcttactaagtcacagtgcattcacaactatgagaagttggatgggcttctctaaatcagacaaaaagtactttccagaaattgcctgttcagaacaataaactcttgggttgttacaagcttaatcttgaacagagccctcacatcccatatggtgaaaacaggaggttggaatgggattgggaagagttgggcatttccttatgaaggtttggagagaaaaggggggatgggaggtgactaccatttgaaagggctttcagccaatttggaggaaatctcttctggaactccagggtcaaattggtttcaggctagaattgattgacatgaatccctgaaggagagaggactagctttggaaagatagggtagggaagtgtgaggaaactatttgattttacacgcctagattgtttcatttgttcattgacattctgactactggatcttttcatttgctttgcaaggaagactttagaggactctggcctgggccttgagaagaattctattaaaagattctcagcctcctgtgtggccaggatctgcccaggataaagaggctattcctccttgctggagataatcttgagacaaccttgcatttccagtttccctccttgggcagcctaactatgagggagggaaacatggcttgcaataaattagcattgtgtcttcattcaggaattgaggcttccagcctcatatacctccttttgggctttgtgatattcttgcccaagaagtaccatttctacagaaatacaactgactaatcttctagcagggttctttttgaaaaaccccatgcaccttaacccacagcaggtccttggtgatttttgcccagacaaccagaaggctatttgcttactgcccacttacaatgaccagatcataggaaattgaaaacagtgtcagactatttagtcctaatctgtcccagattaagagaatccatgattttcagggggagggagccctgcaatgccttgacccctgcccagatacttcttacataaaccaaagaaaaatgacaagagtgtacatctaaccagacagaagtagaaacaaagtatagaaaaacctcctctttggaatcagctcccttaatgtggtcccccttctcttggacctgcccaacctttcacaacgtcttgaaggtaggacttctatatccagcaaaggaagggatagtagtaaatttacatggcttggaattttctttctggagccacagagggatgaatcctttggagctctaaaagcaaccagtatcactgagctgtgagatacctatatctccattttctaataggaagcacttggacttaaaattgctaagatattttttgcagttgctatttctgtgcatcttgaatctatctgacacaatcaaatgacagtattgttaactctcacaccattaagaaaatttcttattttgtaggcattcactgtgagaggtaaaattgctgctttggcaggtatgattccagtttgccaaacggcttttcttccttccacaacctctttttcccctagcccagggtgaaacaagtgggtcatctccaaccttgatttttatttggattcagcattttgggtttggaaggttacaagaaggaaccataaatggccatattcctagatttttatttatctgacaaaatacacaacttaaaagccaggaaaactaaggttcattacagggagatgaactttttctaattggaggacaaattgtggaaggtggggtctgatctttgcttcaccacttgaagagactgtcatccttcacctgaggttccatttctagcttttatgtgacctctcttgaacaaagtcatttgggaacccccagaaatgacccctttacattgtaggaccataagcaaaacactggttgtgtatagtcactgatccccaaggacttgcagttttttatttctgctggtgtgtcttgggatcagcttataactcctactcttacttagtcagtgaccagtccagtctggtctggaccaggcctgacaaacttctgctcacttgcatcattttcattctgagccagtaggactttgggtagactttaaagcccaagaattggtactcgctttggctagtgacatttgatttttgtctccatcttgatttctgacatcattggccaagtcacattaactttttttgatcactgagaaaaacagtcgaacaaggcattacagagggtggttaaggtagagggtggggggcaggaatgcttatgtaggatagaaagaatgtgggggtagctgtttggttatggtgatccagtcctttggaaccttacaaggctcctgtgggcatgtcaatgttaccattacagcctctacgacccacccacctttgaaaagtcagtacaagtagaccacagtttaaagtagttagtataattctactaaggtttaatcattatacttgttcacttcctggtgcatatttcctaaatatgcttggggtgtggggtggggggttgagttttcactgttccattgcgtgtcatcttatatttttctccatcctgtgactttggcatcttactcgactttctattttcttttcccttggcttattgcagtagtctgctggtgcaggtagagagctcagtgcacctattcccctgttactgctaattatcttgaatattgtcagaggttattttgatgttctaagaatataaagtcattttttacaaaatcatcttttccaagttaaaagcaaaataaaaaaatcccctgtgctagggtgcccatttcagcttttgacattgcccctgtacttttatagatgctctttttgtccgtgttggtagtaactaatgactagtgaattttcatgtaaatgaagcaaaataaatatttcagattttattaatctctcataacccagccaaatctgatgacttcattttaattgcttcccagaaagcacttcccctcctaccttctattctattctattctattctattctattctattctattctattctattctattctgttctattctgttctattctgtttttagaataacacactaggtaaagaaactttaactgcaaggagtcagtgacttttagtgctccctgataaatgatgttattgacaaaagtaaaaaattatttcattgtttttttcctgtattactatctcctctcctgtgcttttgacagtgtgtttagtggatggataatatgtatttctctttcccactcccagattccaaattccctgcctttttggcccacctcaccacaaaagctccatagtttattaatgtaagtttgaatggatgcttctttggggaaacttcaggagttaatggaagagtttcagaaaggaatgagaatgcctcaggagttgttctgtgatggaaattggtctgttgttctgttaatgctgatggaaagaaacttacaacgcttaataaaaatctattcttttagtaaaaaaaattgtgaaataa

SEQ ID NO: 131902 - DNA, 1140 bp, Homo sapiens
  Payload ID: 5748
  Gene Symbol: FAM120C
  Gene Name: family with sequence similarity 120C
  Uniprot ID: Q9NX05
  ENST ID: ENST00000477084
  CDS Start-End: 84-800
cacgcgcccgcccccagcttcgcgcccagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgactcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaagcaagctgccatgttgtgagctgccctatggagaggcccacaggaaaagaaactgagggaagcctccaaccaacactcagtgaggaactgaggccctcagtccaactacagcctgcaaggaactgaattgctgccaacagccacgtacgtgagtgagcttggaagcggatccttccccaggcaagccttgagatgactgcagccctggctggcaccttgattgaagcctgtaggagaccttgagccagaggacccagctaagccatgcctacagatactatgagataataaatgttgttttaagccactaagtttgggggctactttgttacacagaaatagataactgaaacaccatt

SEQ ID NO: 131903 - DNA, 4554 bp, Homo sapiens
  Payload ID: 5749
  Gene Symbol: FAM122A
  Gene Name: family with sequence similarity 122A
  Uniprot ID: Q96E09
  ENST ID: ENST00000394264
  CDS Start-End: 111-974
gcccgctgacagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgccacggcctgctgctgccggcctcccctgtccgcatgcacagcagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatcccttgatttttttaaataactgagagctctatttatttatgggattattaagttctgatgaaaatataaatgttgacttaatcagcatagtaaactgatgtttaaaattccatacttcatgcccacactaatttttaatgttattttcagtggttgccgatttccatttgatgaagaactatacagcttaaaaaaatacgttagttatatctatctagtggttgtctgttttacccaggaattcttggatatttagttttctgggtactgaagtggatgggagggggaatgattaaagaacaaattataaaagtttgaacaaatcttttcaaattaagtatataaaagtaaacttttaagaaaaacatttttaatgagattttaatagtaattctagtcagtcatacaactataactactatagagaaaataaaattttttcctttttttttttaaccggaaagtgcatttgcttgggtgtaatcctaaagtgaaatgggacagtgccttgcagtctttgcccactatacataggctaaggctaagctctttgtactactgcaaacttaaaagtttttcaaatgtgggaaacgtgtgggaaggcttgttgaactttggcgcactcaggtaaacaatactctctcaattgttgatatactttaaaatattcagttgtgcctcagttccagaaattattgccaaacaggagccacagcaatttttggctacttttctgctctgcccatctgtcaccttactggttttcccttgttcaggaaggaagcagctgtttccttgccaacaggtcccttcctctccatctcccaccaaactagggcaccattgattagacaaaggtacagtgtaacttgggtttctgacagcaacaacaggactgtgaattgtttaacctctgtggttaaagctacagcttgagttgactgccttggggatgtcagttaattaaggggtgatgatttgcaagagaaaattagtggagagtcacataggtaaatcattatttaacttaggttttcctaaagttagaatagtcgaatgttcttttctttacctttacaattaagacaaaatgtttaataagaatagcaaaaatttttttatattatgcatccttatacctcacatatcttccttaactagatagtttgacagaaagaatggcatacaaagaggaaaggggaaaaatgactcagaacaagacaaaagctctgactgtttaaagttatcgcttacagagactttaacaattttgtggaatttttacaactatgagagtaaatggaactggtcaactcttgacagttgcctcaagatggagtgaaattgcatcgagggtaagactgtgtccacaggtttaaaattctctcttctgagtaatagtgttcatgtgctcccattctcgaccctgttgttgaaattcaaacttaaatagcctgacttcttgttgggtaacttgccctgcctccagaggtatttgaacttcattatcttcaacacaggaattgttaatcttctcacttcacctgttcttgcattagctcaattgatgtcatcactgatttcctaaactagaaactatggaagcatctttgacttttccttttctctgttggattagcttaatcaccaagtcctgtcaacttctgaaatgaatctcaaatttcttcccttctctatctgttgcccctgattttgccttaagttcttgcctgagtgatctcccagcctgtcttctgtctccttttggttcagtctttatactgcctcttgagtaatctttctgaaatttaaacttgatatttttcgccctcttgcttgaaaacttcacttgcttccccatttcctactctttaaggaatgatttctttagcctcagatagaaggacctttatgatctggccatattctgaaatagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctccttatttctacctctattgccactctgatccaggctaccagcatttccctcttaggcttctgaagcaacttcctaactcccacttgtgctcctcacactcactctggtcggctatccattcattctccatacagcaactagagtcattcttttaaaattgcggacctgatccttccatctcccagctgaacgcttttcatttgcttcctgttctcatgagtatgccaaaatgtattaattctgggctaggaggccctgaggaatttggtccttccctcctcccccctcgttttctgtgcttcgccctcactggcttgcctttcttttccttaaatacatcatgttctctcctattttagatccttttccccgaaggtatggaaacattatttctgtaagcttattcttctatatagatgggaagtttttaaatcagataaggttctaagggcatgtggacaatttacgttatcatagtattgttcataacgtccatcattattctgtagactgtaagggcttacttagctcgtgtaagaattatccttcaaaaagcatttttaaggtattagtattgctaatctataaactttgtgcaagaagtcctaaagtcaatagcaacatttatttaaagtacagtttgtcatacttaataaacctctggtatattttcctttattatgcttgttaaaaacacagtataaatgggagaaatcattaaagatcattaactccaaggctgctggatgttaggacccttaagcatacttaaaagattgattgtaatcaagaataacttgtatcagattgccttccagtgattcacatttattagttcaaccagttacatacctgtagcaagagaccagtttatttggcaataaaattggggaaggaatcaagacttaaatgaggaaa

SEQ ID NO: 131904 - DNA, 2706 bp, Homo sapiens
  Payload ID: 5750
  Gene Symbol: FAM122B
  Gene Name: family with sequence similarity 122B
  Uniprot ID: Q7Z309
  ENST ID: ENST00000298090
  CDS Start-End: 263-988
attggagtggccgctggacgcgtgcgcaggacccgatgggtgcccggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgttgctgtcatcctcacctaatcgtattcctagtagcagactgcatcagatcaaaagggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaattt

SEQ ID NO: 131905 - DNA, 4326 bp, Homo sapiens
  Payload ID: 5750
  Gene Symbol: FAM122B
  Gene Name: family with sequence similarity 122B
  ENST ID: ENST00000343004
  CDS Start-End: 951-1754
cgcttctgaagcgtgggaggcggaagagactgcaggttgtagattttggtcttggccccaacgggttcccccagaccattagaacccgagagaggaagaggaggcaccgcggcggcggctgagaggccgaacccccaacctgtcctcgaggcgggaggggggcagggaggggagaagcaccgatcccagggctgaggagcctccgggaccgggtccgggagcatggggggctggaccgggtccccgagcatggggagctggagccgccaaggccgcccggccgggtcctacccgactgtcaggtcctcggtgctagcgctgcccgggcagccgcagcatctgtagcccggccccgcttgtggtcctcagccggaaagatagcagcatgagttccgccgctgcctagtttcctccccctcctcttctccctcctctctcctcttcccagaccacctccttctttcccgcccctgcgcttcttttcccttaccctctgtcctcctccctcccctctgccctctcccttcccctccctcctccgcccccttcctctccctttcccccctctgccctcctcttatcctctctgtcctcctgcttttccacctatccttttccctccctcttccctcctccctccatccttgttttccctccatccttctttccttcatccttttccttcattctgtcaccttccaccactacctcttcgtcctcctctcctgcctcaccatcatcctcccttcctcatcatcatcctccttccctcctcctctcctacttttctccgcccccagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgttgctgtcatcctcacctaatcgtattcctagtagcagactgcatcagatcaaaagggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaattt

SEQ ID NO: 131906 - DNA, 4246 bp, Homo sapiens
  Payload ID: 5750
  Gene Symbol: FAM122B
  Gene Name: family with sequence similarity 122B
  Uniprot ID: Q7Z309
  ENST ID: ENST00000370790
  CDS Start-End: 930-1673
ggaagagactgcaggttgtagattttggtcttggccccaacgggttcccccagaccattagaacccgagagaggaagaggaggcaccgcggcggcggctgagaggccgaacccccaacctgtcctcgaggcgggaggggggcagggaggggagaagcaccgatcccagggctgaggagcctccgggaccgggtccgggagcatggggggctggaccgggtccccgagcatggggagctggagccgccaaggccgcccggccgggtcctacccgactgtcaggtcctcggtgctagcgctgcccgggcagccgcagcatctgtagcccggccccgcttgtggtcctcagccggaaagatagcagcatgagttccgccgctgcctagtttcctccccctcctcttctccctcctctctcctcttcccagaccacctccttctttcccgcccctgcgcttcttttcccttaccctctgtcctcctccctcccctctgccctctcccttcccctccctcctccgcccccttcctctccctttcccccctctgccctcctcttatcctctctgtcctcctgcttttccacctatccttttccctccctcttccctcctccctccatccttgttttccctccatccttctttccttcatccttttccttcattctgtcaccttccaccactacctcttcgtcctcctctcctgcctcaccatcatcctcccttcctcatcatcatcctccttccctcctcctctcctacttttctccgcccccagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaattta

SEQ ID NO: 131907 - DNA, 1381 bp, Homo sapiens
  Payload ID: 5750
  Gene Symbol: FAM122B
  Gene Name: family with sequence similarity 122B
  Uniprot ID: Q7Z309
  ENST ID: ENST00000486347
  CDS Start-End: 70-816
agtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcaca

SEQ ID NO: 131908 - DNA, 1059 bp, Homo sapiens
  Payload ID: 5750
  Gene Symbol: FAM122B
  Gene Name: family with sequence similarity 122B
  ENST ID: ENST00000611027
  CDS Start-End: 218-1021
ggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgttgctgtcatcctcacctaatcgtattcctagtagcagactgcatcagatcaaaagggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttc

SEQ ID NO: 131909 - DNA, 1078 bp, Homo sapiens
  Payload ID: 5750
  Gene Symbol: FAM122B
  Gene Name: family with sequence similarity 122B
  Uniprot ID: Q7Z309
  ENST ID: ENST00000493333
  CDS Start-End: 218-1018
ggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgttgctgtcatcctcacctaatcgtattcctagtagcagactgcatcagatcaaaagggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtgggg

SEQ ID NO: 131910 - DNA, 1368 bp, Homo sapiens
  Payload ID: 5751
  Gene Symbol: FAM122C
  Gene Name: family with sequence similarity 122C
  Uniprot ID: Q6P4D5
  ENST ID: ENST00000370784
  CDS Start-End: 407-994
ggcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactggtgaaatggcatttcaatatcaaccaaaaaagattttccaaggcacaaccaacatgctttcttctgatacttcccaactgtcagaaaataatgtgtatctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaatgatgtttgacaattatgt

SEQ ID NO: 131911 - DNA, 1344 bp, Homo sapiens
  Payload ID: 5751
  Gene Symbol: FAM122C
  Gene Name: family with sequence similarity 122C
  Uniprot ID: Q6P4D5
  ENST ID: ENST00000370785
  CDS Start-End: 406-864
gcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactgaatgacaatggcttacagaaatcatcctctctaaagtgcattgatttaactccagtatcctcaatggcttcttccatcaagaagactgggaagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaa

SEQ ID NO: 131912 - DNA, 2119 bp, Homo sapiens
  Payload ID: 5751
  Gene Symbol: FAM122C
  Gene Name: family with sequence similarity 122C
  Uniprot ID: Q6P4D5
  ENST ID: ENST00000414371
  CDS Start-End: 174-521
gaggaccacaagcggggccgggctacagatgctgcggctgcccgggcagcgctagcaccgaggacctgacagtcgggtgagggcctgggacagacgcagcagactgggatatgcaaagagaggagtagcctaattgtcaagtctagatctaacaaaagcagtgtcccaagatcatggcatatttccctggaactggaaggactgatcaagaaacacagctagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctact

SEQ ID NO: 131913 - DNA, 2064 bp, Homo sapiens
  Payload ID: 5751
  Gene Symbol: FAM122C
  Gene Name: family with sequence similarity 122C
  ENST ID: ENST00000623326
  CDS Start-End: 227-466
ttatcgcaggctctgaggggcgggacccaactgattgtcaaaggcggcagattgtagtttttgttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctact

SEQ ID NO: 131914 - DNA, 2104 bp, Homo sapiens
  Payload ID: 5752
  Gene Symbol: FAM124A
  Gene Name: family with sequence similarity 124A
  Uniprot ID: Q86V42
  ENST ID: ENST00000280057
  CDS Start-End: 132-1880
gagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcaatggattctccacctggcggatgccatgttgcctgttcctttactgtacacacggtgacaaagaaaagggaagatggagcctccaggttgaacatacctggccctcaggtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtc

SEQ ID NO: 131915 - DNA, 4761 bp, Homo sapiens
  Payload ID: 5752
  Gene Symbol: FAM124A
  Gene Name: family with sequence similarity 124A
  Uniprot ID: Q86V42
  ENST ID: ENST00000322475
  CDS Start-End: 136-1776
gcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtcataaaatatattttttgaatattcagcatttgaggtatggtttagtgggtttatacaatttaaatggcttatataattatttgaaatgaaaagaaaacctagtcagccagaaccaatttggcaatttttccatggtatgaaggcaaatcaattaaggccaaaacgttgaatgtgggagagatagtaagtgacttgtatgagggattactgcataataacgtaacgcacaccttactggattctccatatatatttacattaccagagaacagtggccctagggatgtttaagcactgcttataatggaaaaagtcagcttgagaagtaaacgtatatcagactacaggtaattcctcatcttgaagccatgcaacacctgcaaatctggatttatacaaaagttgctaatgtgtttcataaagatttagcatgagtaacagactcttggtgcatttaaaatatgtgagttccagaaagtagatttgcatacaccttttcaacagcacatttcactggaatggatgaggggcttctgaagaccactccactacctgaatttatttggatcactgaggaagagcatttgttgggattacagaattataggccattagacatcatgggtaggtagtcttaagatccttcaactttcaaaaaccacagtctaaggactatattcaaatgacaagagccgcactgtatactgctttctgcagtgaccatgctgggtcacgcatcctatgtttctcatttttaaatgatttggaacattttagccagcattttgatcacacagattaataatgctgttctccccaaaacgggaaactttacctgaaacgctctcctgaacaaacaccagtgcactgccagcctcacatgattgcatgggagctttaattaacgctggagcccagcaaccttggcttttcctgcctgttatctgctactgtcacaccgtgaatggtatttgaatctcacctccctctcacctcagtaagagtatgtttgtttacagccccaacctcagcaatgccaaaggctggcatcgggggcagtgccaagctgtccctggatactatttacctttgaggaagaacagcatgggtttgccaagctcaattcccaggctggtgctccttgaattaatcatggcacagtgttcatctctctggaaatgcccacgccagcccagacacagcctcagagtcctttccaacacgaccctccaggcagcagttaccaaccatcagtcttcagctgaagcttcaagtctttgccatccttgtaatgacagccttaggccttgccccaagcattctggactctctaacactcagaattgtaatgtaatattctgctctaatttaaatttttaaaaatatagtctcctaattcaggataaggagtaagcaaactttctgaaaagggctagataataagtattttaggctttgccagtcatatggtctcttgcagctactcaactctgccactgtagtatgaaagcagccatgagtaatatgttaatgaatgggaatggctgagttccaataaagctttattttttttttatttgagacggggtcttgctctgttgcccaggctggagtgcaatggcgcaatctcagctcactgcaagctctgcctcctgggttcaagccattctcctgcctcagcctcccaagtagctgcgactacaggtgcgcaccacaatgcctggctaattttttgtatttttagtagagacagagtttcaccatgttggccaggttggtctcaaactcctgacttcgtgatccacccaccttggcctcccaaagcactgggattacaggcatgagccaccattcccagccaataaaactttatttacaagaacagctggtgggccagatttggcccaagggtcatagtttattatcccttgagctaggctgctgcctgaggttgattcaacatcccagctccagtcaacaacaaaaattctaagtctcccgcctaatgctgctgtggtgtgtcatgccaaaaaagtgggctactcaggttagaccaatgacttcagaaccacagggctcagaacaggaaggagcttctttctgcagagctgattcctggaaagccaccagcactccaccttctgcccagaaatgtgattcagtcaatagctgatgaggaaaagcaacctgcaaacattaggaagaaggagaaaaataattcagaggtgatgataccacctccaatgaacagggaagcaagttcatcagtaacaaaagtcagtgaggcaaaaaaaaaaaaaaaaaaaaaaaaaaaaggctaatggccgagggctggctccttctttctccctaatcagtgtccttatttcagtgtgctcacatgctcgcctaggactgctttagagtacaactctggacccgccctcatcacagtccaatctaccaaactgagtgaccctaaaggacatcatagacaacatttgaaagcaagaaatgcaaaatgttcccatagcatcaggtgagcagggagaggatgcccactgtagaccacatggaaatggcagtccctccacggagagggaatcacaggaacacatttaccaaagccttcccttccattcctggccattccagtagcatcttcctcatccagaagggcttccaatactctctggaggatcctgactcgtttggagtattatccttgtaaaagatgctggcacattgtaggtgctcaataaatgtgttcaattgaaaaata

SEQ ID NO: 131916 - DNA, 2383 bp, Homo sapiens
  Payload ID: 5752
  Gene Symbol: FAM124A
  Gene Name: family with sequence similarity 124A
  Uniprot ID: Q86V42
  ENST ID: ENST00000615498
  CDS Start-End: 169-1074
gggagagggcgcggcgcggggttcgcggctggcgcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggtactggggggacgcctgtctgtctgtttaggggacctgagaaaccagttagctttgcctcaaacactatagtaccagtcacagagcaatgatcaaggaaggagagatcagtgaccctctgcccagctcctagtcgaagtcaaagtggccatacaggatcccaacaaaagagggggcaagaaagactcttcccattggttctcttcatttcactttcagcaaacatgttcccaattcttccagctgccccttctgtcctcccctattgggcatccactaaacacccatgactcctggggatttcaaatgagcttataagctagggaatttgctattaaagattcctgaatctatgcccatgtacttagagagtttttaccactggattcttccctcccacaaaggaacttcaggaaagcccatctatctggaaattttaaaatatatattgatgttcatagaggagatagctgttctcttccttcaggtgcctcccccaccttctactcttgcatccttctactgctgggcagcaggttgttgaaatcctgtgatcacttggaaaaggatgtcccgttaaacattttaaggagtaagtgatgccttgggagcttctggtttcactaagcttggaaggggtgaaggaattcattttaagtaggctgccctagtccttccatggtaaactctttagcttcatcatcagctccctttctcctctcatccttccaggggttgtcccagactcattagagataattagttatactcaattcaaaattcagcatgtatattacagaacatcctacatctggtcctacctgagaaatgctttccagacccaggctttcttgattttacaagtaaattagttccaggagtatagggccttgtttttctgaaaagcctctacctctgacgtctcaattttcacacttggctacccgaaaagagaaagttgatagtgaattgggggacattgccttaagaggcaaagattgtggttacttgaatcacaggtaaagtttcatcgtttttgttggttttggctttaagcaccagaactataatccacatatcatgaaatgaagtcagaatttggcacatgtcagataactggttcagactacagccaggcctcatttctcgtcagaaaggtcaccttgagatacttactatttataggaactagataattttgaaacttccttttgaactgtgcagataaggaactaagtaatgttttattattcaatatgctagcatttgctctataatcccttttgaaatgtgagaaaaattgtctctgtgtttgaagaatgccacatctttatgcaaaatataatacagttgcaccaagtaaaagttaatgaaatgcaaa

SEQ ID NO: 131917 - DNA, 2376 bp, Homo sapiens
  Payload ID: 5752
  Gene Symbol: FAM124A
  Gene Name: family with sequence similarity 124A
  ENST ID: ENST00000614765
  CDS Start-End: 169-1029
gggagagggcgcggcgcggggttcgcggctggcgcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggtactggggggacgcctgtctgtttaggggacctgagaaaccagttagctttgcctcaaacactatagtaccagtcacagagcaatgatcaaggaaggagagatcagtgaccctctgcccagctcctagtcgaagtcaaagtggccatacaggatcccaacaaaagagggggcaagaaagactcttcccattggttctcttcatttcactttcagcaaacatgttcccaattcttccagctgccccttctgtcctcccctattgggcatccactaaacacccatgactcctggggatttcaaatgagcttataagctagggaatttgctattaaagattcctgaatctatgcccatgtacttagagagtttttaccactggattcttccctcccacaaaggaacttcaggaaagcccatctatctggaaattttaaaatatatattgatgttcatagaggagatagctgttctcttccttcaggtgcctcccccaccttctactcttgcatccttctactgctgggcagcaggttgttgaaatcctgtgatcacttggaaaaggatgtcccgttaaacattttaaggagtaagtgatgccttgggagcttctggtttcactaagcttggaaggggtgaaggaattcattttaagtaggctgccctagtccttccatggtaaactctttagcttcatcatcagctccctttctcctctcatccttccaggggttgtcccagactcattagagataattagttatactcaattcaaaattcagcatgtatattacagaacatcctacatctggtcctacctgagaaatgctttccagacccaggctttcttgattttacaagtaaattagttccaggagtatagggccttgtttttctgaaaagcctctacctctgacgtctcaattttcacacttggctacccgaaaagagaaagttgatagtgaattgggggacattgccttaagaggcaaagattgtggttacttgaatcacaggtaaagtttcatcgtttttgttggttttggctttaagcaccagaactataatccacatatcatgaaatgaagtcagaatttggcacatgtcagataactggttcagactacagccaggcctcatttctcgtcagaaaggtcaccttgagatacttactatttataggaactagataattttgaaacttccttttgaactgtgcagataaggaactaagtaatgttttattattcaatatgctagcatttgctctataatcccttttgaaatgtgagaaaaattgtctctgtgtttgaagaatgccacatctttatgcaaaatataatacagttgcaccaagtaaaagttaatgaaatgc

SEQ ID NO: 131918 - DNA, 2030 bp, Homo sapiens
  Payload ID: 5753
  Gene Symbol: FAM124B
  Gene Name: family with sequence similarity 124B
  Uniprot ID: Q9H5Z6
  ENST ID: ENST00000243806
  CDS Start-End: 318-1136
cgcagaaaccctggggaacgcctgaaaaggctaaacacaagcagttacattatgcacaagctggatgacgtgaccccgctgctgctgtgtggagagggaggctgctgaacccgagctggtgtgagcttctcttgccgtaagtccacgggtggccaggagcacgtgttagtctggttaagagctctgctcagaagtagccgctgcagctgaaggttttcaggcgggctgaaggctgggccgcttcttcattcatttcagaaacttgaacagtgggccttctacacacgctgtctttgtcagcctcaggcagttcctccatggatgagacacaggggcctctggccatgactgtccatcttcttgccaactctgggcacggctcccttctgcagaggactctggaccagctcctggattgcatttgcccagaggtccggctctttcaggtgtctgaacgggccagtcctgtgaaatactgtgaaaagtcccattccaagcggtcccggtttccagggatgtccgtgttgctcttcctgcacgaaagcccgggagaggataggctatttcgcgtcctggactctctccagcattcgccatggcagtgctaccccacccaggacactcggggaaggctgtgtccctacttttttgccaatcaggagttctacagcctggacagtcagctgcccatctggggggtgaggcaggtgcactgtggctccgagatcctgagggtgacgctgtactgcagttttgataactatgaagacgccatcagactctacgagatgatcctgcagagagaagcgaccttgcaaaagagcaatttttgtttcttcgtgctctatgcctccaagagctttgctctgcagctctccctgaagcagctgcccccgggaatgtcagtggaccccaaagagtcttcggtgctgcagtttaaggttcaagagatcggccagttagtgcctctgctacccaatccatgcatgcctatcagcagcaccaggtggcagactcaggactacgatggcaacaagattctgcttcagagatgggagtcttcctctgttgcccagactcgagtgcggtggtgccatcatagctccctgaggtcttcaccttctgggttcaagtgatcctcctgccttagcctcctgattagctgggactacaggcacgtgccgccatgtctggctattttattttatttctagagacggggtctcactatgttggccgagcttgtttagggatgttaagtttgcagtactattgacttaatttttattctttattattatactttaagttctggggtacatgtgcacaaagtgcaggtttgttacacaggtatacatgtgccatattggtttgttgcacccatcaactcgtattgacttaatttttaagcatcttgcatcactgtcaaattttaccacataccaagttagatagaatgctttcttaaaaaaacttgaaattaaagccttcctttgtaaccatcctcgaaaacctaacatagcatgtgtgtatttagtcatgatagctgccgtgcattgcctttccatggtatgtgagcctgggcacttagtagctgtatgactgtgggcctcagtttcttcattagcacaataaaggcacccgagaattagcatcttcctctctcatacttacttacaggaaatgacctgacacttataaagtacataattaagatagtgccaagaactcaattttagctattattgttcatattatgccctatactaaggattctcttaaattgataattttatttaatacttataacaacctatgaagttactatttttcccattttggagataagaaaactgagctttccagggggtcagttatttgcccaagataggaagtatctatctaccctcaaagttcatgtggtcagccgctgcagtccagtgtatgtgtgtaaatgtgcaagcagggggatgaatgtcatgttcacagcaaaatatcctgtggcttctgtccttaagaaatggtcagaa

SEQ ID NO: 131919 - DNA, 2594 bp, Homo sapiens
  Payload ID: 5753
  Gene Symbol: FAM124B
  Gene Name: family with sequence similarity 124B
  Uniprot ID: Q9H5Z6
  ENST ID: ENST00000389874
  CDS Start-End: 227-1045
gagagggaggctgctgaacccgagctggtgtgagcttctcttgccgtaagtccacgggtggccaggagcacgtgttagtctggttaagagctctgctcagaagtagccgctgcagctgaaggttttcaggcgggctgaaggctgggccgcttcttcattcatttcagaaacttgaacagtgggccttctacacacgctgtctttgtcagcctcaggcagttcctccatggatgagacacaggggcctctggccatgactgtccatcttcttgccaactctgggcacggctcccttctgcagaggactctggaccagctcctggattgcatttgcccagaggtccggctctttcaggtgtctgaacgggccagtcctgtgaaatactgtgaaaagtcccattccaagcggtcccggtttccagggatgtccgtgttgctcttcctgcacgaaagcccgggagaggataggctatttcgcgtcctggactctctccagcattcgccatggcagtgctaccccacccaggacactcggggaaggctgtgtccctacttttttgccaatcaggagttctacagcctggacagtcagctgcccatctggggggtgaggcaggtgcactgtggctccgagatcctgagggtgacgctgtactgcagttttgataactatgaagacgccatcagactctacgagatgatcctgcagagagaagcgaccttgcaaaagagcaatttttgtttcttcgtgctctatgcctccaagagctttgctctgcagctctccctgaagcagctgcccccgggaatgtcagtggaccccaaagagtcttcggtgctgcagtttaaggttcaagagatcggccagttagtgcctctgctacccaatccatgcatgcctatcagcagcaccaggtggcagactcaggactacgatggcaacaagattctgcttcagagatgggagtcttcctctgttgcccagactcgagtgcggtggtgccatcatagctccctgaggtcttcaccttctgggttcaagtgatcctcctgccttagcctcctgattagctgggactacaggttcagctgaatccagaacttggtgttaagaatggcatcttgggagctggcatgcttcccctgggctccaggctgacttctgtctctgcaaagaggacctcagaacccaggagccagaggaaccagggcaagaggtcccaggggcattctctggagcttcctgagcccagtgggagccccacatcagacaggtgtgctggcacttcgtggaaaagccctggccggtcattccaggtcagcagcccagctatgggtgcccacctgcacctgtcttctcatcaccttgaatccggggccagaatgaaggtcctcaaccgggaaaacagctttcagaagcttgaggccgagacgaatgttgacaccggcttgaccatcataaattctgaacccaggcagacttattttggcggatttccaagggatttacagaccagccagccaccattctgcttgccagcctcttccttgggggtggctacctccaaaaacaacagtgtccttaaggaaagagtctctcctttgccacttgctggccaaagggaccttggtaccaggaagacaatttcagaatgtctccttcatctgcaagttcagggtgaagaaaaagaagaagatgaagaagaattctttatatagcataaaataaatgtggttttctaaaacacaagatcagataaaatgttctagaaatggagtactgacccagaatcagcctgttagttgttcatctgaggggggctgaatgctccccatgcacaatctgtattgattttatttcaaatgttcaaagtctaaaggtgctgggaatgattgtttatttgccgtcacagtcataagagaacacagccaacacacagggaaaaaaaccgaatgcttttgttccgtggagatgcactaacccagctggatgtgttgaatccagcacctatcaggataattgcattgtatgcaaatgaatcggtatgttatacaacactaattagtgtctgtaatttggttttaatttttacttaggttgcatagctcatccccctggacaatatggactgctatttactcttgaatgctttttaattttcatgtgacctcttttggtaactaggccttgttcacataccctccttgtgattttgtctttaaagttgtttgtatctggaatgagtgaaaatgcaaagtgttttgaaaattataaacagttaattttgttttcctgtttaatgagccaaaatactggaagccagaaaatcaggttgaacatgaatgctaggctctagggctttcctgctcatctgcttctcatttgtttctgcactatgtcaaagaggacagtggttcttgttacaaaccaaagaggaacattgagcacagtgggaaaattggactggttgatctggtcactggagcaggacttgggttcttctggccagattttgactcccagattcctttacaaaacgcactcattcattcatttatatatgttcattcaataaacattttttgaataccta

SEQ ID NO: 131920 - DNA, 2509 bp, Homo sapiens
  Payload ID: 5753
  Gene Symbol: FAM124B
  Gene Name: family with sequence similarity 124B
  Uniprot ID: Q9H5Z6
  ENST ID: ENST00000409685
  CDS Start-End: 267-1634
atgcacaagctggatgacgtgaccccgctgctgctgtgtggagagggaggctgctgaacccgagctggtgtgagcttctcttgccgtaagtccacgggtggccaggagcacgtgttagtctggttaagagctctgctcagaagtagccgctgcagctgaaggttttcaggcgggctgaaggctgggccgcttcttcattcatttcagaaacttgaacagtgggccttctacacacgctgtctttgtcagcctcaggcagttcctccatggatgagacacaggggcctctggccatgactgtccatcttcttgccaactctgggcacggctcccttctgcagaggactctggaccagctcctggattgcatttgcccagaggtccggctctttcaggtgtctgaacgggccagtcctgtgaaatactgtgaaaagtcccattccaagcggtcccggtttccagggatgtccgtgttgctcttcctgcacgaaagcccgggagaggataggctatttcgcgtcctggactctctccagcattcgccatggcagtgctaccccacccaggacactcggggaaggctgtgtccctacttttttgccaatcaggagttctacagcctggacagtcagctgcccatctggggggtgaggcaggtgcactgtggctccgagatcctgagggtgacgctgtactgcagttttgataactatgaagacgccatcagactctacgagatgatcctgcagagagaagcgaccttgcaaaagagcaatttttgtttcttcgtgctctatgcctccaagagctttgctctgcagctctccctgaagcagctgcccccgggaatgtcagtggaccccaaagagtcttcggtgctgcagtttaaggttcaagagatcggccagttagtgcctctgctacccaatccatgcatgcctatcagcagcaccaggtggcagactcaggactacgatggcaacaagattctgcttcaggttcagctgaatccagaacttggtgttaagaatggcatcttgggagctggcatgcttcccctgggctccaggctgacttctgtctctgcaaagaggacctcagaacccaggagccagaggaaccagggcaagaggtcccaggggcattctctggagcttcctgagcccagtgggagccccacatcagacaggtgtgctggcacttcgtggaaaagccctggccggtcattccaggtcagcagcccagctatgggtgcccacctgcacctgtcttctcatcaccttgaatccggggccagaatgaaggtcctcaaccgggaaaacagctttcagaagcttgaggccgagacgaatgttgacaccggcttgaccatcataaattctgaacccaggcagacttattttggcggatttccaagggatttacagaccagccagccaccattctgcttgccagcctcttccttgggggtggctacctccaaaaacaacagtgtccttaaggaaagagtctctcctttgccacttgctggccaaagggaccttggtaccaggaagacaatttcagaatgtctccttcatctgcaagttcagggtgaagaaaaagaagaagatgaagaagaattctttatatagcataaaataaatgtggttttctaaaacacaagatcagataaaatgttctagaaatggagtactgacccagaatcagcctgttagttgttcatctgaggggggctgaatgctccccatgcacaatctgtattgattttatttcaaatgttcaaagtctaaaggtgctgggaatgattgtttatttgccgtcacagtcataagagaacacagccaacacacagggaaaaaaaccgaatgcttttgttccgtggagatgcactaacccagctggatgtgttgaatccagcacctatcaggataattgcattgtatgcaaatgaatcggtatgttatacaacactaattagtgtctgtaatttggttttaatttttacttaggttgcatagctcatccccctggacaatatggactgctatttactcttgaatgctttttaattttcatgtgacctcttttggtaactaggccttgttcacataccctccttgtgattttgtctttaaagttgtttgtatctggaatgagtgaaaatgcaaagtgttttgaaaattataaacagttaattttgttttcctgtttaatgagccaaaatactggaagccagaaaatcaggttgaacatgaatgctaggctctagggctttcctgctcatctgcttctcatttgtttctgcactatgtcaaagaggacagtggttcttgttacaaaccaaagaggaacattgagcacagtgggaaaattggactggttgatctggtcactggagcaggacttgggttcttctggccagattttgactcccagattcctttacaaaacgcactcattcattcatttatatatgttcattcaataaacattttttgaataccta

SEQ ID NO: 131921 - DNA, 3130 bp, Homo sapiens
  Payload ID: 5754
  Gene Symbol: FAM126A
  Gene Name: family with sequence similarity 126, member A
  ENST ID: ENST00000409923
  CDS Start-End: 189-1448
agtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatgagcaacctgacaacaataatgatgctactgaattgggcatccttgtcattcctgagattagtgtcacaaatgtggccggagagagaaccgggaatggggaaaaaggcagaacactaggagagattgatgctcagcatatacagggtgtgcaggaaacagccacagatcctagaactgagagcaaaggcttgccagagatcaggaggcaaaaatctgtaagaaaaatgatggaggatggaataaactcacctggcagagtgcagttttagcagagcactttataactgcactccaaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaa

SEQ ID NO: 131922 - DNA, 616 bp, Homo sapiens
  Payload ID: 5754
  Gene Symbol: FAM126A
  Gene Name: family with sequence similarity 126, member A
  ENST ID: ENST00000409763
  CDS Start-End: 179-523
gggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggtttgtatttaatggagttaacaaaatcttttttgacaaaatcaaatatataacctgtgcaactgcttttcattttaataaagctagtgtttgttttttcataca

SEQ ID NO: 131923 - DNA, 6337 bp, Homo sapiens
  Payload ID: 5754
  Gene Symbol: FAM126A
  Gene Name: family with sequence similarity 126, member A
  ENST ID: ENST00000440481
  CDS Start-End: 1-1415
agagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctgacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatgagcaacctgacaacaataatgatgctactgaattgggcatccttgtcattcctgagattagtgtcacaaatgtggccggagagagaaccgggaatggggaaaaaggcagaacactaggagagattgatgctcagcatatacagggtgtgcaggaaacagccacagatcctagaactgagagcaaaggcttgccagagatcaggaggcaaaaatctgtaagaaaaatgatggaggatggaataaactcacctggcagagtgcagttttagcagagcactttataactgcactccaaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaaatgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttacagatgtctttttgtcattctttaacaatgaatttcccctgtgcatagttattaatagtattggtattattaaaaactaatttggcattttaagattggcattttaagcaagttgaggtgcttaggaaacattgtagaataagtttggggaaatgttagctgacagagctgagagatcagattttcatgttctatcactgtaatggaacctcatttagacctctctagacctttgctagctgtgtggtctgaggaccagtaagtaggattggcattatctggtatcttgttaaaaatgcagaatttcatgccactctaggtctactaaatcagaatttgcattcttaacaaggttcccaagtgatttttatgagaagaaagtatcagagtgcaaacaaattactcgtctaatatgtagaattcccagtggtctcacagccctagatcaaatgtgtcagacactagatcattataatcttcattggttttgacagctaattaattagtttaataatattgacatatggcttcttaagtatttgaattctagattgctaatgatccttatttttgcagtaaaaaagtaacactttatatttttcttgttaactataaatggaatcagagctgtaaatgcctgaaattttaagtgtgaaaaggggtgccacccttttatatactgcacaacaaatttgcatttgtatattctttttaaaaaatctctgaagacttgctcagtgaaatggttctgattttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctatagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcacaataaatctgtattaaagggaagcacatcaaggaaatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtactttatacaacaagtgttgcctcttgttttattgaaataaaaact

SEQ ID NO: 131924 - DNA, 13177 bp, Homo sapiens
  Payload ID: 5754
  Gene Symbol: FAM126A
  Gene Name: family with sequence similarity 126, member A
  Uniprot ID: Q9BYI3
  ENST ID: ENST00000432176
  CDS Start-End: 234-1799
gagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaaatgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttacagatgtctttttgtcattctttaacaatgaatttcccctgtgcatagttattaatagtattggtattattaaaaactaatttggcattttaagattggcattttaagcaagttgaggtgcttaggaaacattgtagaataagtttggggaaatgttagctgacagagctgagagatcagattttcatgttctatcactgtaatggaacctcatttagacctctctagacctttgctagctgtgtggtctgaggaccagtaagtaggattggcattatctggtatcttgttaaaaatgcagaatttcatgccactctaggtctactaaatcagaatttgcattcttaacaaggttcccaagtgatttttatgagaagaaagtatcagagtgcaaacaaattactcgtctaatatgtagaattcccagtggtctcacagccctagatcaaatgtgtcagacactagatcattataatcttcattggttttgacagctaattaattagtttaataatattgacatatggcttcttaagtatttgaattctagattgctaatgatccttatttttgcagtaaaaaagtaacactttatatttttcttgttaactataaatggaatcagagctgtaaatgcctgaaattttaagtgtgaaaaggggtgccacccttttatatactgcacaacaaatttgcatttgtatattctttttaaaaaatctctgaagacttgctcagtgaaatggttctgattttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctatagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcacaataaatctgtattaaagggaagcacatcaaggaaatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtactttatacaacaagtgttgcctcttgttttattgaaataaaaactgaaaaaaatattttttccagatcagtttactcatttaaaaaattattataaaaatttgcagaagttttgatatgaaggaagagaataaaggaggaagacttaggtaagttgagccattgagagcttttgggggtaagtgataagacaatgacctcattcctggctttgtgctttacatgtcatagggctgaggagtatgacaggtccactcgtattcatccaaagatgaagatgagctctatgggccatgcaccagtggcggattatttgtcatatcagaagcacaggcaaatttaggtaacatcactttgtccttctaactttagaatctttattgccatgtgtggtgagtagtagtcccaactactcaggaggttcactcgagcccaggaatttgagaccagcctgggcaatataacgagatcttatctcttaaaaaaaaaaaaaaagcaaaagaagaagaaagagtctatatctcttgagtacagagattatatgcccctagtacctagataggactttgtgcgtggtaggtatctagacatttatgagacaataaatgagttaggttgatgttagctttggaaaagaatcaaggataagtcttcagtgttttctttaacagtacaattttagaattttgtttgttggctttaggaaatctcagtggcattacatgaattgcattatagcatgtacttagaaaaaagaacttatggctgggtgcggtggctcacacctgtaatcccagccttttgggaggccgaggtgggtggatcacctgaagtcaggagttcaagaccagcctgaccaacatggcgaaaccccatctctactaaaaatacaaaaattagccaggcatagtggcgggcacctgtagtcccagctactcaggaggctgaggcaggagaatcacttgaatctgggaggcggaggctgcagtgagccgagatcatgccactgtactccagcctgggcaacagagtgagactctatctcaaaaaaaaaaaaaaaaaaaaaaaaaaaaaaaaacagaacctattaacctattagacacttgaaaaaattcctggcttgtagttgattatatgtttggttaattccatttcatctaaggaactaagtaatttaggaaatgtgttcttaactactcttagaagggtacttgtagagaaccagagtggtgattttgtaagcagtattttgtcctatacaatatgcactcttccagtaactccagtagtccacatagctgactcacctcctacaacccgactttgttaatatcaagataactgttttataattgtagagaaagattttttacaaccagttgtagttattattttctttgcattatgttattgtgatagtagtggtagctaatatgtgtaattaaaatgatcatcttatcctcaaaatcatcctataaagtgcatagaatccccattttacagaagaggaaactgaagctctcaatagggtagaggacttggctaaggtcacctagctgctgagtggcaaaactcagccttgaacacaggtcttaggactctcactttatatagcttggtaaaagaagatactaattaaatcctacctaatagagatgtatttaaaattcactcaccccatctgtcttacaggtaatagttttaaggtaagataaaatcaaagtgttctaaaagtaaatcataatacattttacagaattagagataattgtgttttagtggtcaaacaatgctcgttattctgttagtaaaagcatggtaaaatgcaaattaaaataagatttctctttttttttcctgtcagattgataaagatgaaaaagattggttctagtattgacattggtatggggaaatcattagtcactgagatgattagcaggactgtagattggtacaaatgaattggtgggcagttcaacaggatctatcagactttaaagtgtatctcataccctctgaaacagccatcctactcttctatatttattccattctctgtattctactgaaaatttagcacaaatatataaacataagcatgcaaggtattcattgcagtattgcttgtaatagcaaaaacaagccagcaaatctaaatgtctgttaatagaggaatagataaattatggtacgtacatatagtggaatataatgtagccattaaaaagaatgcagatctgtatgtgatgatttacattgattattcagtgtatgatcccacttgcattataaatgtgtgcagtagttaaatatgagtgtgtgtatatgtataatacacacttacgtttgctagtatgggggaggagagcattgtttctcaaagtgtggtctaaagacagcctgcattaggaaattttttttttaaatggggattcctgggcattgtgctaatttccctgaatcagaatcactgtgagtgaagcatggaaacctgtatttctaacgggttcctcagttgatggcttatacaaatgtaaaatatggtctagtagctgtcagcaatgaattggatatctggtagtggattgtagttagaaagggcaaacttcttgaagagatcttgtattttaaatgaggcctacctaaaataaagccagttgagtaacgttatcagcatagacctgttaatgaaggtgaattggcctgacatagaaaaatgattctaccatacagcactacacaccaactaaatgagcaagccttttaaaaaatccttgttgaacttcccaaatatcagatgacctgttaataaagcacaagtaaataataggacttactgtggtaagagaaagtgccaccttgatttggttgtgtgtcagaaccagaaagtaagattatttgtagggctttgggatctatgctcaaatggtttaaggtatgtctgtcaaggcagggaactgattgggattagcaaagttgatagttcagaattagtggacacagcaagcagggttcttgaagattcctgaaaagtcaactgttgtttgagaaacaagctgtttgcccaggtgagcagggcttcacctgtaggaattgtcttcaaccttaggaatttcctctacaaacaacaacaacaaaaaaatagggattgttcttgtttttatttgctttgttttgtttgtaatcttatctttcctgggcaaagatttcctggaataaacaactaagttatgttgacatacatgggctacagtcttatccaagctgtattgacactgatggattcagtttgtttttcttagctctctctattcaaagattataagtcaatattatgtatatagcaattgacaggtcataagtacggcatgctaactgatcgtaccactggagctccaacaattgatgtatctttggtgacttcttagtgttctgctgaagatcgcaaagatttctgtagcttcttgacctctataacacttggttcacacttgttaagtgttctaatataatccacatcacattgtgctgtgacttatctttctcatatttgtctccctcactagaccacagccctgtgggaatataatataactaatacataatggtgaataaagatttgttttactagatagaatataaatcgaatccaggaaatcagtggcagcataggagagactgtgttgcttctcttctattcaatagaagtctttgaaactccttttattctctaatattcttcatggagatgaaaatgaaggttgtaaagctttactctgattattttaagcatgcctgcataaaaatgttttgagaagtaaattatgcatcatgtttctctttagttagactatgaatggtgtgaagaattttctgggctaatgtttgacatttattattcactcctgtagatttgtggtgaatatgaatggtatctggactaatcagaaaacaacgtaggaaaggcctaacttcaacactgaattcttgctccttgtctcacttgcttccttttgtagaaactacaagtatatttaacttttgtatcctagatccactacggcctactgaaagcctatcatgcatttatctttaaacttttactctcttcatttagccaacatatttctacttctatgttgcctgctgtgctgtgtaattttctacaaacattttcacctccaaatcccttgaaatgaaaccctctggaagagcatcaccactttttcttcctctattctaattcccctctagtttcccctctagtttaagacttttgtttcaatatttattctttccttaagcctttaaattcatttatatccaccaagttgaatttgatgagacaggacatgtttgaaagaaggacaaaccaaacaagcaagcaaacccatgaatactcgtacaataggacataatatacatttcccagttccctgaaggggtaaaattgagactggttatacaagcagtattgcacagcatgctgatactagctagacatagcctacagtgtttcagcttcactcaaagatggttctggaggacagtgaggaaatgaactttttccagcgagaataaatatgagcagtatttctagtctgctttgcaccgaaagtgagccatcccaagatacagatctacaccatttatacctggccaggtggttggaaacacagacgtaataagattggaggatgagtgacaaaaattgggagctaaacatattggacttcttaaaataggctcagattgcaagaataattgtttcctacagacatattaaacaaaggccctgtggtgaaggaggtgctaaataatcagatggtcaagatgactttgaggatatcagtaaatctctttggtattccagcctttgttcaaacagtttatgggcaaagcggctatactggaaggatagggctacacaggaacttcaacaatacaggcctcctttcatcaaggctgtccttattactgccaggagccgaactggccagcagcagtgaccatcctaagatacaacatctgagggtgaccagatagttagtggcagattgattatatcaaatattttctttcatggagagacaactatttgtcctcatggaatagagccttactctggatctggctttaagtttgccttccctaagcaccatgcttgtgtgtgcaataataagcttcctgttcaccattatgattttccccaaaatattgcttctaagaaacttattttacaatgtaatcagtgaggtagaggtagaattacactttcagtcatgggaaactaggtaattaacatcaaaattcccattggcaactagataatccagcaaaactcttcaaaacatgaaaatctaggccaggcgcagtggcttatgcctataatcccagcactttgggaagccgaggtgggtggatcacctaaagtcagaagttcaagaccagcctggccaacatggtgaaagcccgtctctactaaaaatacaaaaaaaattagccaggtctggtagcacatgcctgtaatcccagctactcaggaggctgtggcaggagaatcgcttgaacctgagaagcggaggttgaggtgagccgagatagcaccactgcactccagcctgggcaacagaggaagactctgtctctaaataaataaacatgaaaatctagagaggcaagcattggcacaacttctttcctggaggtattggctgattctagaagcatttaaggggataagcagtgcttcttactgctccaggatattaggaggacaaaaactgaatgccagtgcctgccaagtcataaaagagggcttaggaaattcccatgctttgggctgggacccaaaaaagctccaccataggagtaagagtgaattggaagtgcatcaactctcccccatacacagggaattcagcacggattcaaaccatcccaattcctgaaatcagattaaaaatgatcccctaagtgcttggtaataaacaaatcctctgtggaggtggaaaaaaaaccccatcatcttaagcctcaagttctacaatttttcaaatacagtcttcacaagagaaaagaaaaataaccagacacttctatagcagagcaacactcattgagaacaacaagcagctttgggtaaaattgcttaaaacctctgtttgaagccattgaagaactttcagctaaacaggactctagaagacaaaacgccagagagaaggtgtgcagaaaagagttaacataagaggctgagatgctatccttagccctgattttaaagctgggctttggctagtgtctgggaacttggattaccggaatgttcccaccattccctaactgataagggggtttactctttgtaaactatataaacaacatggtttatgctgaattcccgctttgcttctaggagtctggaattatgatttgtgctgggcagagggtgcctctatcactaacttccaatacaaactttgggcagtaagactctaacgagcatccctggcagacaacatttcacacctgttgtcacaattcagtactgaagtaattaaccacagcctgtgtgattccacaggcaaaggattcttggaatcttgtgtcaggtttcctctggacttcaccccatgtccttttcccctttgctgatttgctttgtagtacttttctctaataaatcatagccatgagtatgactatatgctgagccttgtgagtgcttctgttgaatcactgaacctggggtgctggcgtggtcttggggactcccaatacaaaagtattttaaccagagaagtgagcagacattctgcagctacttcttccattatggaatttgccaaatctgggtaaaaggcccaagaagagagttactgttaagaatcagagaagcaaacaagttatggaaaccacacaggactggagaaacaaaaagaacagggcctttaaaccaatcgcacttgggagagcagagatcctagtaagacaggaagttcagagaagtgagcctggcactttccttgttttcctcttgagtatttgctgaattcttggattgctcagagagggaaaaaaaaaaaaaaaaaaaaaaaa

SEQ ID NO: 131925 - DNA, 4778 bp, Homo sapiens
  Payload ID: 5755
  Gene Symbol: FAM126B
  Gene Name: family with sequence similarity 126, member B
  ENST ID: ENST00000286181
  CDS Start-End: 185-487
ggcaggctgctgcgggaggcggcggcggtaggaagccggagacagcagggtgacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagatacagcctccaagagtgcctctgctgtgtactggagtgagtttgaagaagttcagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgcaacttctcacaggggtttattatgccatgtataatggacagtgggaccttggccaggaagttcttgatgatatcatttatagagcccagctagagcttttttctcaaccactattggttgccaatgccatgaaaaactcattaccatttgatgctcctgattctacacaagaaggccagaaagtccttaaagttgaagtcactccaacagtgccgaggatttctcggactgcaattacaacagcttcaatccgtcgtcatagatggagaagagaagatggctttgacttctcaaacgaggctgactcgagtattcctggctccccgatccaacacggctccactgacctagggatcaaacgtgtgcaagagggggaggtgctggtgcgcaggacccctgagcatggctcgccggagcccaactcagcaacagccacaacagagggtgctgagggtgtaaatggaggagaggagtctgtaaacctgaatgatgcagatgaaggattttcatcaggggcttccctcagcagtcagccaattgggaccaaaccatcctcctcttctcagaggggaagcttaaggaaagtagcaactgggcgttcagccaaggataaagaaacagcctctgccatcaaatccagtgagagccctcgagattcagtagttcgcaagcagtatgtacagcaaccaactgatcttagtgtagattcagttgagctgacaccaatgaagaaacacctgagcctgcctgctggccaggtggtgccaaaaatcaatagcttaagtctaatccggacagccagtgcttcctcaagtaaatcatttgactatgtaaatggcagtcaagcaagtaccagcattggggttggcactgagggaggtactaatttagcagccaacaatgctaatcgatactcaactgtcagtctgcaggaagaccggctaggtcaagctggcgaaggtaaagagctcctcagcccaggagcccccttgaccaagcagtctcgatccccaagtttcaatatgcagctaatatcccaggtgtagttttgacatcctccctcatctttctgcttaccttttaaactgaacatttcattgtgcaagaagacacttcatcccacattgtgaaaatattggtcactgttatcagatttcatttagtttaggtatcttcatactgtattttgtatcaaaacagcaataaggttttctttatccctctttcctacatcttctcttcacctatcccttgtaaatgtgtttgtgaagcagtataaaatggttgccttttccatgccttcctttctccttgggtgatgtgcaatccatcgtaggctgatcggtcccatttcaacactgtgagactgagggtacattagaggaaatggtgtatatgatccctatgaaacgattctttggcttttgtttaaaaacaaaacgggtttgttctcataatctatagaactatgaagattactggatcatatttttttctcttaaccaggagtgcctcagagattctgctatgactttggacttctctgagtctgtgcaatcattttctggagaagcatggggaaaggtggtagactgctgcactttttcattaaaatgagggtagctctttctccacccccccatctcctttatcccgaagacataaatgttcaattacggaggcatttaaatcaagttgtgaccacctccattggagggcaggactcttgattgtgtaattgataatgcactttctcaatggctgtatagtcattattaacgtgtcttccctcttccccacaaggacatataaggtcatttctgtccttcaagtttggccaactaacaaatcagaatctgaggggcatgttctatttcccaggaatgattgacactttggtgctggggttttgtgggggcggggggtagtttttgtttagcttttgtggagattgtgtgtgtgagaggagatttgatttttttttcttcttttcctttgtgagctgatggctgaagtgtaacagtacatcttcaggtaaagagagggatttctcaatctactttctgttatgtcagactataagagaaaccctttcagctgctttctagatgtacctaaattcagtcagacattttggattaagaaacctaaagtcctgatacattacatactccaaggaaatatatcagggacagacaattggctgaaacactgatacttcaatgtgacacatttttatagaacatttctaccagggggtactgaccttgatttctcctacaaggaccacactgcctttgtgtttaatgtaatgcaatttgtgtaccttctaatcatatatctgcagttcctcatttttataaaactttgatatcatgccagtaagctagatgttgaatgtatgtaagtagcatttggtaactgctaagaggttacaaaaacattattggtaaaaaaaatttccttagttctgatctggttggataagattttatcataacttttctgggtctcaggctctgatgtttgaaaaagaagggaatatattgggttttaaaaaagtgtattgtgacttaaactgttataagttatccttccacagaatacatcagagctatcagtgctttgtacatttagatgtttttacttgattattgtttaagaaaaatatactgaatttatagaaagcaagtattctcctaattagcaaaagttaaaattttatctctaccattaaaattacaatagattttgataaataaccagaaaaaacgcctttttttttttcacacctagcaatcctcccgtttttattgtaaggactttcttttttccctaagagactttctgttagactctttatatatgagatgcttgtttaaatatggtggtctgtaacatttttccagctcatgtgaaaatggaaaactagaacctgaactagtatctacaacattgccaaagtccagggtaaagctaaaagttgataagtagacaatttattgttttgtgtgtgtctgtgtgtgtgtgtgtgtgtgtgtgtgtgtgtgtatggtgtgtatatgtatatatcacaaagttgtattttaaatattttaaataccctttcttttaatttaagggatgtcaaataaatgaaaggagtttaaaaatagccaaaataaatgagctataaaggcccataacatactaaaacaggcagtttcaggtatgtaaggaaaggaacattatacttacctagaaagtgagatctaaaaaaaaattaaaaataaataaaaaataaaaaagaaagtgagatcttggctatggctggaggtcagtcactttatggcataaattatttgggaggtaaaaagactgttttcaattcaaattgtgcatttattggcatctaaatctagcatgattttggttagagcacaaaagaaataccacataataccaaatcacagcaaatgttagaattaatacaacaaaattttcctttggctagaaatcttatgttatacctgaaaaattggttttaaaaaatgttcatcttggccgggcacggtggctcacgcctgtaatcccaacactctgggaggctgaggtgggtgaatcatgaggtcaggagttcgagaccagcctggccaacatggtgaaaccctgtctctactaaaaatacaaaaaattagctgggcgtggtggcaggcgcctgtaatcccagctactcgggaggctgaggcaggagaatctcttgaacctgggaggtggaggttgcagtgagccaagaatgcactactgtactccagcctaggcaacagtgcaagactccatctct

SEQ ID NO: 131926 - DNA, 9333 bp, Homo sapiens
  Payload ID: 5755
  Gene Symbol: FAM126B
  Gene Name: family with sequence similarity 126, member B
  Uniprot ID: Q8IXS8
  ENST ID: ENST00000418596
  CDS Start-End: 189-1781
agttggcaggctgctgcgggaggcggcggcggtaggaagccggagacagcagggtgacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgcaacttctcacaggggtttattatgccatgtataatggacagtgggaccttggccaggaagttcttgatgatatcatttatagagcccagctagagcttttttctcaaccactattggttgccaatgccatgaaaaactcattaccatttgatgctcctgattctacacaagaaggccagaaagtccttaaagttgaagtcactccaacagtgccgaggatttctcggactgcaattacaacagcttcaatccgtcgtcatagatggagaagagaaggtgctgagggtgtaaatggaggagaggagtctgtaaacctgaatgatgcagatgaaggattttcatcaggggcttccctcagcagtcagccaattgggaccaaaccatcctcctcttctcagaggggaagcttaaggaaagtagcaactgggcgttcagccaaggataaagaaacagcctctgccatcaaatccagtgagagccctcgagattcagtagttcgcaagcagtatgtacagcaaccaactgatcttagtgtagattcagttgagctgacaccaatgaagaaacacctgagcctgcctgctggccaggtggtgccaaaaatcaatagcttaagtctaatccggacagccagtgcttcctcaagtaaatcatttgactatgtaaatggcagtcaagcaagtaccagcattggggttggcactgagggaggtactaatttagcagccaacaatgctaatcgatactcaactgtcagtctgcaggaagaccggctaggtcaagctggcgaaggtaaagagctcctcagcccaggagcccccttgaccaagcagtctcgatccccaagtttcaatatgcagctaatatcccaggtgtagttttgacatcctccctcatctttctgcttaccttttaaactgaacatttcattgtgcaagaagacacttcatcccacattgtgaaaatattggtcactgttatcagatttcatttagtttaggtatcttcatactgtattttgtatcaaaacagcaataaggttttctttatccctctttcctacatcttctcttcacctatcccttgtaaatgtgtttgtgaagcagtataaaatggttgccttttccatgccttcctttctccttgggtgatgtgcaatccatcgtaggctgatcggtcccatttcaacactgtgagactgagggtacattagaggaaatggtgtatatgatccctatgaaacgattctttggcttttgtttaaaaacaaaacgggtttgttctcataatctatagaactatgaagattactggatcatatttttttctcttaaccaggagtgcctcagagattctgctatgactttggacttctctgagtctgtgcaatcattttctggagaagcatggggaaaggtggtagactgctgcactttttcattaaaatgagggtagctctttctccacccccccatctcctttatcccgaagacataaatgttcaattacggaggcatttaaatcaagttgtgaccacctccattggagggcaggactcttgattgtgtaattgataatgcactttctcaatggctgtatagtcattattaacgtgtcttccctcttccccacaaggacatataaggtcatttctgtccttcaagtttggccaactaacaaatcagaatctgaggggcatgttctatttcccaggaatgattgacactttggtgctggggttttgtgggggcggggggtagtttttgtttagcttttgtggagattgtgtgtgtgagaggagatttgatttttttttcttcttttcctttgtgagctgatggctgaagtgtaacagtacatcttcaggtaaagagagggatttctcaatctactttctgttatgtcagactataagagaaaccctttcagctgctttctagatgtacctaaattcagtcagacattttggattaagaaacctaaagtcctgatacattacatactccaaggaaatatatcagggacagacaattggctgaaacactgatacttcaatgtgacacatttttatagaacatttctaccagggggtactgaccttgatttctcctacaaggaccacactgcctttgtgtttaatgtaatgcaatttgtgtaccttctaatcatatatctgcagttcctcatttttataaaactttgatatcatgccagtaagctagatgttgaatgtatgtaagtagcatttggtaactgctaagaggttacaaaaacattattggtaaaaaaaatttccttagttctgatctggttggataagattttatcataacttttctgggtctcaggctctgatgtttgaaaaagaagggaatatattgggttttaaaaaagtgtattgtgacttaaactgttataagttatccttccacagaatacatcagagctatcagtgctttgtacatttagatgtttttacttgattattgtttaagaaaaatatactgaatttatagaaagcaagtattctcctaattagcaaaagttaaaattttatctctaccattaaaattacaatagattttgataaataaccagaaaaaacgcctttttttttttcacacctagcaatcctcccgtttttattgtaaggactttcttttttccctaagagactttctgttagactctttatatatgagatgcttgtttaaatatggtggtctgtaacatttttccagctcatgtgaaaatggaaaactagaacctgaactagtatctacaacattgccaaagtccagggtaaagctaaaagttgataagtagacaatttattgttttgtgtgtgtctgtgtgtgtgtgtgtgtgtgtgtgtgtgtgtgtatggtgtgtatatgtatatatcacaaagttgtattttaaatattttaaataccctttcttttaatttaagggatgtcaaataaatgaaaggagtttaaaaatagccaaaataaatgagctataaaggcccataacatactaaaacaggcagtttcaggtatgtaaggaaaggaacattatacttacctagaaagtgagatctaaaaaaaaattaaaaataaataaaaaataaaaaagaaagtgagatcttggctatggctggaggtcagtcactttatggcataaattatttgggaggtaaaaagactgttttcaattcaaattgtgcatttattggcatctaaatctagcatgattttggttagagcacaaaagaaataccacataataccaaatcacagcaaatgttagaattaatacaacaaaattttcctttggctagaaatcttatgttatacctgaaaaattggttttaaaaaatgttcatcttggccgggcacggtggctcacgcctgtaatcccaacactctgggaggctgaggtgggtgaatcatgaggtcaggagttcgagaccagcctggccaacatggtgaaaccctgtctctactaaaaatacaaaaaattagctgggcgtggtggcaggcgcctgtaatcccagctactcgggaggctgaggcaggagaatctcttgaacctgggaggtggaggttgcagtgagccaagaatgcactactgtactccagcctaggcaacagtgcaagactccatctctgaaaaaaaaaaaaaaaaaaaaaaaaaaagttcatcttagaggattttatttatctgtatgtatatacatatatgtttgtatgtatacatacccacattaacattttatgaccctgtaacatttgttttctattcttttaggtgatgtgaattgacctcagtgaagaaacatttcatttagtctaagccttgcattcagggtcttacaacagatttcttgtgcaagaattattattagttaaaatggaaggtgttagtttaacaaactgagagtcaaattttctaagtttttaaatatgcattttaacatgcattatttttggcatttaatttaaaatagttttgtttcatgtatacaacagctgttacagatatatgccagcaatattcatacttttttaacaagcttttgttatatattttctaatctccataaaagtctaatcatctatgaaaaagatatttagggagaaaatacttgttttctgtaataaaacaattaggttggtgccatgtatgccaagttggataaaagaatacaaagaaacagctgaaggttttgggagctcgctctgacattaattactagaaagcaaactaaaatgcaaagtgaatagttaactcagaagatttgaattttttgaaatagggtctcactctgtcctctaggctagagtgcagtggcactatcacggctcactgcagcctcaacctccctgggctcaggtgatcttcccacctcagcctctggagtagctggaactccaggcatgcaccaccacacctggctaatttttgtatttttagtagagacgaggttttgccatgttgcccaggctggtctcgaactcctgggcttaagagatccacccacctggcctcccagaagtgctaggattacagacataactaccacacctggcctgaagatttttaaatgtgaaaatattttaagaagctaaggggaaaatcgttattttaaaatcctgatccccttaactttaccccttaccattccccttacctttccaattcacttttgtctatttattatagaatcagaattgtgctaagaagaaaccctggagataatctagctagtctcccactccctcaccccaaccttcatcctcaagaaacagaggctcagaggttgtggtgtgatcaagatcatatacctaaagcagagccagaatcaaacccagtctcccatgggtttggggaggcagtgggttgttaactccatttttgcagtttctttatagttctggtctagtagttggtgaatacaacacattaagaaaagtgttaaatccagaaaaaatgtagagtaatctagatggggaaatgttggaaatgttaagtatatctacagatgtaaggatcaatacattattctaatttatgccttactattttctgccacataacagttgtatgctgccattttatagttgaatacatttgttgggatttatttaaatataaaataaaccctgtgaaatggctttgatcagtgttttctagttattttaaagtaatttttgagtcagccagctttcagtcaccagtgtggcaagctaattatattgcacaatagagtattgcaaagtaaagattaaataaatttgattccattactttttaatgtagaaagagactgaatcttatgcttagagcaaatgcaagcaatatttccttatatgattgaaaaaggttctatagtgtgaagcttatgattccataatggaacagtgaccatgatgtcatttaaagtgtgtatataccatataaaatgtcttaaatgcggtagtctcagctatataagctcagtatttccagtctgtattctcagattccatctagtagctttaaattaattaaaattgtttattagacactggaatactgagaataacttctttcagattgttttgtttgcaccacttttgtgaatattttaatgaagtggagtccatttttgagtacttcagttgttgacaatcagttgtctcgtttaaatctctgcatgttcatttgtaaataaaaaatgtagtacctgtctttaggggtagtcccctatttattacaaacactggcaaggaatatctgtccatttctgaccttggattacaaagtatgttttgggtttttccttttttaatcagtatttcagttacatctttgttttcagctttaaaaagtttaacgggtcatgccaatgatcagaaaatctgtaagaattttagagcaatttttctatgtacagctatgttaaacagtctgaacatgagactttttctttcaagttgaagattattgtcatcgttttaccactaagttggttgagacacttacttgtaatactttaatttttttaaagtgtttttagaaacaagttgtttgaaaaccaattagaaattagaatatttgccagattataagcagatggaatgcagtgtaaaactgttaacaatgctaataaaattatgagtcatcagattggtacagttttccctgccaagatggtcatattgataatgtaagacaaattttagtattacttgcattatgtgtacctaataggtatatcatactggtactgagcatatatagaaaatactattcatagaggagtcatcaccacccaacctccttgcctgtgtaggcatatttcttctgaacctgaccacacaagtacaacattttggtaacttcagtcttttcagtatttttgtaatcttagccatagtcctatgagaaatgtacataagagcaaacaattcaggatagaaattagcagaaagctgggaatgatgtgaaataactggcagcatagtacagaaatgtaaggtatatgttttgcttctggatttttagaaattgtgctaatcatgtttacaaattaaggcatattcagatgtctgctattatgtttaatattgatttgataaaaaaatggaattaggtgtagcttagagtataaatgagtctttttaaaaatgtgtatctggaagtagggctaataaagaaatccttttattttcaaagaaatgaacttaattggacaactcatccccaattacagaattgatatcaatatggtttgctgtatttgagtataaacagctcagtgttaattatatcaaaggaagttctttacatcttcattgattacaaaatttaccaaagaaaatgtatctaccaaatataatttttaaagtacttgttaaggaatgaggcctctttaacatataaagtatcttaaaaatattctctgacctggaaaataggtttacagtagctacaagattccattttaggttttcttatgtcaataaatgtcaatattttacacttccagcaaaagtacccgttaaagctaaatctaaatattattcctcatagcacagtttctggtctccttaaattaaggatcctactcatcaggattgaataaaaagggggaaattcctaaaattggtatattgtataatattgtgggttaagtaaaatttaggggggcattatggaaatgtacctattttaaagggcagtggcaattactataatattggttaaactggtaaagtttgttaaataatttatgtccatgatcattctgagtgttttttttctttgcagaaaaacaggattgggttaagaaaagctaaaatactcatttttttaaaatgtatagcccaataagaactaaatgatttatttcaaaagttaaataattttttttggaaatcatggaatgtatttgcatattgatgttccaaacaggttttatgtattgttttttatagcagggagtagttgaaaagtaatgagtatattgattagctgtcttggaaagagaggattggctttctaacaatcactgatacaggtttgggtttgggggggtttgtttgtttgtttttaagttttatcatccatactgaattgagagatatgctccatgtttaaaaatatttgtaataagttcatctacttgacactgaatcttttttattcttactctaaaattattctggctttacattcagtttaagtggttaagtgaaacagtttttagggtgcaaaaattattttcccactgtttttctcatgataatttgagtctcctgagctataatttctgaaggatttttactactttggcattatgtaatctgatctctgtcacaatgatattaaataagaactatctcactttcatatgtttgcttcataaaaggatatggaatgtacacatcagctctttttttttttttaaactagcatcaacctataacttggtataaacttcccaagtatttagagaatagtgctggtgaaaatttaaataggataggcatatagaaattatgacttgtattgagtgatgtcctttcaacctaggactagtgacaaccttcattttttcagagctgaagaaaaaaccgtgaatttaagatcatatttattggtgcatgtaagccattatcctgtcttaatgaaccgattaatgctgttgattgttgaaatgtgaaatgtagtcactgttgaccttgtaaatatctgccagagatgaaaaaatattttaagttattgtaaataaagatgtataaaattcagtatcagtctgcaatgcagaaacatatcttagatgttaaaatactgtgtttgagagatgtgtaatttacccttagatgtatctagttacattaagagtgtaaatttttttgtacagtataaaaatacagctctatttggcttttaactgga

SEQ ID NO: 131927 - DNA, 692 bp, Homo sapiens
  Payload ID: 5755
  Gene Symbol: FAM126B
  Gene Name: family with sequence similarity 126, member B
  ENST ID: ENST00000452799
  CDS Start-End: 67-692
ggcggcggtaggaagccggagacagcagggtgacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccag

SEQ ID NO: 131928 - DNA, 536 bp, Homo sapiens
  Payload ID: 5755
  Gene Symbol: FAM126B
  Gene Name: family with sequence similarity 126, member B
  ENST ID: ENST00000453765
  CDS Start-End: 275-536
aaagtgctagatgaagaggggttttcttctccttcggccgcggaaactacagacgggagctggcgagggtggtctggaaaggcggtagccggtgtgttggtggtcccggaacctctcgtaaaccagatggagtttcgctctcccaggctggagtgcaatgctgcagtctctgcttactgcaacctccacctcccgggttcaagcgattcttctgcctcagcctcccaagtagctggggttaaagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttac

SEQ ID NO: 131929 - DNA, 522 bp, Homo sapiens
  Payload ID: 5755
  Gene Symbol: FAM126B
  Gene Name: family with sequence similarity 126, member B
  ENST ID: ENST00000446678
  CDS Start-End: 270-522
cgggaggcggcggcggtaggaagccggagacagcagggtgacaggctggagtgcagtggcgtgatctcggctcactgcagcctcgcctcctgggctcaagtgattctcctgcctctgcctcctgaatagctggcactacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagatacagcctccaagagtgcctctgctgtgtactggagtgagtttgaagaagttcagctcctggagcctgtctgccatcagctgtttgagctctatcgtag

SEQ ID NO: 131930 - DNA, 1181 bp, Homo sapiens
  Payload ID: 5756
  Gene Symbol: FAM127A
  Gene Name: family with sequence similarity 127, member A
  Uniprot ID: A6ZKI3
  ENST ID: ENST00000257013
  CDS Start-End: 19-360
gcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 131931 - DNA, 1244 bp, Homo sapiens
  Payload ID: 5757
  Gene Symbol: FAM127B
  Gene Name: family with sequence similarity 127, member B
  Uniprot ID: Q9BWD3
  ENST ID: ENST00000370775
  CDS Start-End: 68-409
ttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgagctcctacatgttcgtggacgagaacacgttctccaacgacgccctgaaggtgacgttcctcatcacccgcctcacggggccagccctgcagtgggtgatcccctacatcaggaaggagagccccctgctcaatgattaccggggcttcctggccgagatgaagcgggtctttggatgggaggaggacgaggacttctaggccgggagacccttgggcctgggggcgggtgctctgggaagagttcgctgtgccagtggccaccgctagggtctccacaggcgccctccctccgcgcctccctccccctcgagccgccgcgatgtcccctgcgctcctgtcccctcccgcgtagtgcttgcctttgttccaggaatagcgctccaggctcctgctgcagctcctgggccgcactctagagcgcgctgcctccgccctcttttgccagcccagcccctccatgcacatttggacgctgtcctgcacttcaggtgcaagctgggctcctgttacatactggacagaccacccacagccgctgctgccaacccacctccactcctccagactgccagccaactacatcattctgcccacagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgatgggtgccttttgttcaacacagtaagccctgctcccttccctgctctaatacactacctgtacaaaggttttttccttatttttaataaatgtcagacactattaaatagaaa

SEQ ID NO: 131932 - DNA, 2026 bp, Homo sapiens
  Payload ID: 5758
  Gene Symbol: FAM127C
  Gene Name: family with sequence similarity 127, member C
  Uniprot ID: Q17RB0
  ENST ID: ENST00000391440
  CDS Start-End: 71-412
tacgcctcggtgcagcccccggcgaagcccagcgcagctcagctaaactcagcggagccagcgcggcgcgatggaaggtcgagtgcagctgatgaaggccctcctggctcggcccctccggcccgcggcgcgtcgctggaggaacccgattccctttcccgagacgtttgatggcgataccgaccggctcccggagttcatcgtgcagacgagctcctacatgttcgtggacgagaacacgttctccaacgacgccctgaaggtgacgttcctcatcacccgcctcacggggcccgccctgcagtgggtgatcccctacatcaagaaggagagccccctcctcagtgattaccggggcttcctggctgagatgaagcgggtctttggatgggaggaggacgaggacttctaggccgggagaccctcgggcctggggaccggtgctctgggaagggtccgctgtgttactggccgccgccagggtcgccaccggcgccctccctccgcgcctccctccccctcgagccgccacgatgtcccctgcgctcctgtcccctcccgcgtagtgcttgcctttgttccaggaatagcgctccaggctcctgctgccgcccctgggcctcactctggagcgggctgcctccgccctctcgtgccagctcagcccctcccatgcacatttggacgctgtcctgcgctccagttgcacaaagctgagctcctgttacacactgacagaccactgacagccgccgctgccaacccccctcctcctcaccagacttccagacgactacatcatgctgcccacagacctgcgctgccactgccatcgccatccatcgcattccaccgacagactgctgcttctagtgatctgtactcacctcggaggtatctgggctggacacagcccctggacaatgatccagacagctggctgcccctcaagggacctgttaccttcagcgagacccatttcctccccaatcccagagactttttgtgctcctgccacatggctgccagggctcagttgtgcctggcagccaaatcgagtctctcattttctcttgtggaccagttagttttgcccagaatccatttctcttctgaatttgcagcattttctcaggtgctttttgatcaacaaaataacttgtatcttctgcttaactcctttatactacctggagaaaagtattttccatattttcaataaatgtcagacactattgagaaagaaatagagtctgaatgaatatggcacctttccctccctggtcctgtaaatgtggtccatatcttgttcagaagcgatatcccctgccattcagtgactgatgttgactcctgcattataaaacatctaagatagagtcctgtggtaacctgggggatagtgtccccactggtgatccttctgtcccagatgttgaatcctctaaaccagttaggattatcccaagcctcttagtaaatgaatcgttacctcattttggtcaacactatgtgagaagtcagccagcaggctcttggaaaatgtatcctcatttccagaaagtggtttgaaaacacaattcccaaattgttacaaaccataaatcccacacagattattggtgaacagctgtaaaattttactcaacccatgattcagggaaccaacagaattatataggtgcttttcaaaagcatttataaattcttgattatgtaggtagtggggggaaatgcagaaatgagatcattaatttagatacaaacctggttgatgaccagggggttttattttgcagaagaattgggtatttggtatcattttattcaattacatgtgatcctggtacatttcataagcttgggtaaaaaaattttttgttattttccatgcacaataagggaaatgttttaattggctttgtgcctcctgctttacaacagttctggcctcaagttaccaggtagcctgaactttgattttattttaccattaaattgctttaataccattgtatttggtgaa

SEQ ID NO: 131933 - DNA, 6928 bp, Homo sapiens
  Payload ID: 5759
  Gene Symbol: FAM129A
  Gene Name: family with sequence similarity 129, member A
  Uniprot ID: Q9BZQ8
  ENST ID: ENST00000367511
  CDS Start-End: 195-2981
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcactctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtagagatgggttttcaccatgttggccaggctggtctcaaactcctgatttcaagcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagcgagggaagttgaggctgcagtgaactatgattttaccactgcactccagcttgggcaacaaaatgagaccctgtctcaaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaaga

SEQ ID NO: 131934 - DNA, 602 bp, Homo sapiens
  Payload ID: 5759
  Gene Symbol: FAM129A
  Gene Name: family with sequence similarity 129, member A
  ENST ID: ENST00000417056
  CDS Start-End: 1-301
tgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaaggtgcctatattccaataaaatgttcatccttgaagagctgaccagatgtcatttatttggaaggaggctggtttcatcttttaagcagatgtcacatttgaattgtgaggtacagccctctgaaacgaaaaggcgagtcattcttgctgtatcatggaccttttacttttctgttgtcacgaaggaatctgcagggaaaccacttaatgtcaggtgtaattatgctttgataatgcatatgcttacgtctccaggaattggatcacattcataatacagcagtgggcaattattcttgatgtaattgaactgctgttcaaacttaaatttattttcaatggg

SEQ ID NO: 131935 - DNA, 3957 bp, Homo sapiens
  Payload ID: 5760
  Gene Symbol: FAM129B
  Gene Name: family with sequence similarity 129, member B
  Uniprot ID: Q96TA1
  ENST ID: ENST00000373312
  CDS Start-End: 215-2455
ggcagggagggggccaaggcggccggctggagggacggggcccgaccgggagcggagccggagcggaagccgcagccgggcggcgggagcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaa

SEQ ID NO: 131936 - DNA, 3760 bp, Homo sapiens
  Payload ID: 5760
  Gene Symbol: FAM129B
  Gene Name: family with sequence similarity 129, member B
  Uniprot ID: Q96TA1
  ENST ID: ENST00000373314
  CDS Start-End: 53-2254
caggaactgggccagttccggtcccttccttttggggctctcactctggaggatggggtggatgggagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagcca

SEQ ID NO: 131937 - DNA, 2222 bp, Homo sapiens
  Payload ID: 5761
  Gene Symbol: FAM129C
  Gene Name: family with sequence similarity 129, member C
  Uniprot ID: Q86XR2
  ENST ID: ENST00000332386
  CDS Start-End: 139-2094
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggccaaaacggatgtgccatctttaggcttttgtaacccctgcaacttcagaaaactgtaccattttata

SEQ ID NO: 131938 - DNA, 2508 bp, Homo sapiens
  Payload ID: 5761
  Gene Symbol: FAM129C
  Gene Name: family with sequence similarity 129, member C
  Uniprot ID: Q86XR2
  ENST ID: ENST00000335393
  CDS Start-End: 139-2232
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttcataggcttctttagctgtcttccttttaccccggacgggatgtagatgttaattctggaacaattgcagctacaagaatttgtcatcctgccccttttgagaaaaacattgtttgcccttgggtctaaatccttccagatgggatgggatgtatcttgtcacctcctttttcttacttaatatgaaaagacctttcctca

SEQ ID NO: 131939 - DNA, 2004 bp, Homo sapiens
  Payload ID: 5761
  Gene Symbol: FAM129C
  Gene Name: family with sequence similarity 129, member C
  Uniprot ID: Q86XR2
  ENST ID: ENST00000449408
  CDS Start-End: 662-1933
agccgaggaacgcaggcggtggtcgtggggaagggaagaggagccccgggagacgacagcagcatgggtgggcggccttcgagccctctggacaagcagcagcggcagcacctaagggaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgc

SEQ ID NO: 131940 - DNA, 5115 bp, Homo sapiens
  Payload ID: 5761
  Gene Symbol: FAM129C
  Gene Name: family with sequence similarity 129, member C
  ENST ID: ENST00000600519
  CDS Start-End: 54-1742
cgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaagacggagtctcactctgtcgcccaggctgtagtgcagtggtgtgatcttggctcactgcaacctccacctcctaggttcaagcgatcctcccatctcagcctcccaagtagctgggattacaggcacccgctatagggaccagccccacagggtcggtgggtctctccctgtgtgcagagacaagagagtgtagaaataaagacacaagacaaagagataaaagaaaagacagctgggcccgggggaccactactaccaagttgcggagaccggtagtggccccgaatgtctggctgcgctgttatttattggatacaaagcaaaaggggcagggtaaagagtgtgagtcatctccaatgataggtaaggtcacgtgggtcatgtgtccactggacagggggcccctccctgcctggcagctgaggcagagagagagaggagacaaagagaaagacagcttaagccattatttctgcatatcagagacttttagtactttcactaactgactactgctatctagaaggcagagccaggtgtacaggatggaacacgaaggcggactaggagcgagaccactgaagcacagcatcacagggagacggttaggtctctggataactgtgggcaagcctgactgatatcaggccctccacaagaggtggaggagcagagtcttctctaaactcccccggagaaaaggagactccctttcccggtctgctaagtagccggtgtttttccttgacacttttcgctaccgctagaccacggtctgcctggcaacaggcatcttcccagacgctggcgtcaccgctagaccaaggagcccttctgctggccctgtccgggcataacagaaggctcgcactcttgtcttctggtcatacctcactatgccccctcagctcctatctctgtatggcctggtttttcctaggttatgattgtagagtgaggattattataatattggaataaagagtaactgctaccaactaatcattaatgatattcatatataatcatatctaatatctatatctggtataactattcttgttttatattttgttatactggaacagctcatgtcctcggtctcttgcctcagcacctgggtggcttgccgcccacaacccgccaccacgcccagctaatttttgtacttttagtagagacggtggtttcaccatgttggtcaggctggtcttgaactcctgacctcatgatccgcccacctcagccaaccaaagtgctgggattacaggcatgagccaccgcacccggcctgtttattttaaaataaaaatatttaaaaataaagataaggaaactaaggcccaagccccgccccccaaccccacagctaatcaggcccagggctagggcagaagcctgtgttgtaggcctctagaggggccctcctctccatccgagcccctaacccgccatggttccaggagctgcctgagttcgagggggatgtccttgccgtgggcagccaggctctgaccactgagggcatctatgaggacgtcatccgggggtgcttgctgcagaggattgaccaagacccttggtgccaatgatgtatcctgcactctggacggctgcttggaggtcccatgggaacaggagggagcagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggccaaaacggatgtgccatctttaggcttttgtaacccctgcaacttcagaaaactgtaccattttatactccaagcagcagcatttatttgtgtattttccccaaggctttctttattttaattttttttttttttttgagactgagtcttgctctgtcacccgggctggagtgcagtggcaggatctcggctcactgcaacctccgcctcccgggttcaagcgattctcctgcctcagcctcccgagtagctgagatttcaggcacccgccaccatgcctggttaatttttgtgtttttagtagagatggggtttcaccatgttggccaggctggtctcgaactcctgtccttaagtgatctgcccccctcagcctcccaaagtgctgggattacaggtgtgagccaccacacgtggcctaattttttttttttaaataatagagacaaggtctcgctatgctgcccaggctgatctcaaactcctggactcaagcaatcctcctgccttggcctcccaaagtgctaggattataggagtgatccactatgtccagcctccaaatcctttctaaacactaggacttttcatgaaaagaaaaaagctatgccagttagacacacacagaaatctcatgattttattttgaatttctttgactaaattgaacttacaaataagtttattatggccaggcgtggcagtgcacacctgtaatcccagcactttgggaggctgaggcgggcagatcacttgagctcaggagttcaagaccagcctggcgaacatagtgagacctcatctctacaaaaaatacaaaattagcggccgggagtggtggctcacgcctgtcatcccagcactttgggaggctgagacaggtggattgcttgagccaaggagttttgaggccagcttgggcaatgtggtgaaacctgtctctactaaaaaataaaataaataaataaataaataaataaataaataaataaataaaatttaaaagaagctgggctgagatgggagatttacctgagcctgggaactcaaggctgcagtgagtggtgattgcaccactgcactccagcctgggtgatgggagtgagaccctgtctcaaaaaacaaaatccaaatatgttgattagccatttacatgtttgtagtttttttttttttaatttcagtgaattgcctgttcatagcttttttctacttttcaggagtgtttgcatttttcttattgatatctaataactctttatatctgaaggatatgaacgctttgtgatacaggttacagattttggggtttttttctccgcttgctgtgagccttttgggtttgtttcctagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttcataggc

SEQ ID NO: 131941 - DNA, 2073 bp, Homo sapiens
  Payload ID: 5761
  Gene Symbol: FAM129C
  Gene Name: family with sequence similarity 129, member C
  ENST ID: ENST00000599164
  CDS Start-End: 79-1941
atccaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggccaaaacggatgtgccatctttaggcttttgtaacccctgcaacttcagaaaactgtaccattttatactcc

SEQ ID NO: 131942 - DNA, 2265 bp, Homo sapiens
  Payload ID: 5761
  Gene Symbol: FAM129C
  Gene Name: family with sequence similarity 129, member C
  Uniprot ID: Q86XR2
  ENST ID: ENST00000595684
  CDS Start-End: 139-2139
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcaggtggggaacttcacaggcttctgaaacatgccagtgattgctgggggtggggaggtggaggcccacatggggtgtatgggattgtcatgagtgtgggttcatggacggaacagaatgcactttgtctccttacccagccagcctggccaagctcgtgaacaagctcagtgggaagttgtggagtgcatctgagccacagagggaccctctaaacccaggctctgacatgcatgtgagctcagccctggggggctgagattgtggtgaatttgtgtcccatctct

SEQ ID NO: 131943 - DNA, 1918 bp, Homo sapiens
  Payload ID: 5761
  Gene Symbol: FAM129C
  Gene Name: family with sequence similarity 129, member C
  ENST ID: ENST00000599124
  CDS Start-End: 38-1792
ggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggccaaaacggatgtgccatctttaggcttttgtaacccctgcaacttcagaaaactgtaccatttta

SEQ ID NO: 131944 - DNA, 1822 bp, Homo sapiens
  Payload ID: 5761
  Gene Symbol: FAM129C
  Gene Name: family with sequence similarity 129, member C
  ENST ID: ENST00000600871
  CDS Start-End: 51-1760
aggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggcc

SEQ ID NO: 131945 - DNA, 2180 bp, Homo sapiens
  Payload ID: 5761
  Gene Symbol: FAM129C
  Gene Name: family with sequence similarity 129, member C
  ENST ID: ENST00000601861
  CDS Start-End: 104-2104
actgtgaccaagcctctcacccgccatccaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttc

SEQ ID NO: 131946 - DNA, 5858 bp, Homo sapiens
  Payload ID: 5762
  Gene Symbol: FAM13A
  Gene Name: family with sequence similarity 13, member A
  Uniprot ID: O94988
  ENST ID: ENST00000264344
  CDS Start-End: 209-3280
ccttccagccatgtgggttcagcggaaagagaagcaaaaccactcttcctaaaatgttagaagctgctcttcgcttaccttggggcctttgcattgggagctgtttttcacatcaaagaatatgtgctgaatggaattttagtattttgctgtcgttttaatattttcgtctggtcttcctcagttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcatgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagatcccaaaatccaggagtgagggatctattcaggcccacagagtactgcaaccagagctatctgatggcattcctcagctcagcttgcggctaagttatagaaaagcctgcttggaagacatgaattcagcagagggtgctattagtgccaagttggtacccagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttc

SEQ ID NO: 131947 - DNA, 4945 bp, Homo sapiens
  Payload ID: 5762
  Gene Symbol: FAM13A
  Gene Name: family with sequence similarity 13, member A
  Uniprot ID: O94988
  ENST ID: ENST00000395002
  CDS Start-End: 358-2367
attgaggagcagaaggagtagggtgcgggggaggaggaggagcgcctttagtgctgcagcagctgctgctctgattggcccggtggttcagctgcttccctggaacaaaaggtcaaagtggactgcagtgtaaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattgaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttc

SEQ ID NO: 131948 - DNA, 581 bp, Homo sapiens
  Payload ID: 5762
  Gene Symbol: FAM13A
  Gene Name: family with sequence similarity 13, member A
  ENST ID: ENST00000506913
  CDS Start-End: 195-581
agtgtattgctccctctcttagctgcacacttcatttgtggctttaggtttttcattacttttcagtccttttaaccattatatctgagcaacatgtgagagatgttagagattttgatttgagttgaagtaaaaataagaccacaactattcatcttcaaacacattttaattcaggtgtttctgttgtaaccatgcaacctcctgtggtaaatatgactgactgctcttttttcttacgctcctttaagcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctg

SEQ ID NO: 131949 - DNA, 3169 bp, Homo sapiens
  Payload ID: 5762
  Gene Symbol: FAM13A
  Gene Name: family with sequence similarity 13, member A
  Uniprot ID: O94988
  ENST ID: ENST00000508369
  CDS Start-End: 198-2291
attgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgt

SEQ ID NO: 131950 - DNA, 3579 bp, Homo sapiens
  Payload ID: 5762
  Gene Symbol: FAM13A
  Gene Name: family with sequence similarity 13, member A
  ENST ID: ENST00000511976
  CDS Start-End: 646-2475
gtgggttcagcggaaagagaagcaaaaccactcttcctaaaatgttagaagctgctcttcgcttaccttggggcctttgcattgggagctgtttttcacatcaaagaatatgtgctgaatggaattttagtattttgctgtcgttttaatattttcgtctggtcttcctcagttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggtgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaa

SEQ ID NO: 131951 - DNA, 2206 bp, Homo sapiens
  Payload ID: 5762
  Gene Symbol: FAM13A
  Gene Name: family with sequence similarity 13, member A
  ENST ID: ENST00000515600
  CDS Start-End: 253-861
ctattaatgaaagccaccaggtgactggcagttttcggagtcaaagaagcctgtgtgtaggatctagggagtcaggtttgaaaaaaagatgtcagcgacttaagacccgtgtcacgtgactccctctacttgccagcactgaggctgtggatcaaatttcaactccaggcagtccttccagccatgtgggttcagcggaaagagaagcaaaaccactcttcctaaaatttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcagtaagttagtggagttttactgttaatatcatcatgtccccctttgtgtttactactgtctgaaattactgggatgtagaagcatatttcagtctgaaaattcagccagcttattttggagaagttgtatcttgttcttgggcatgttagccttgtttttcatcccaatttgaagaaggtagctatgccctttttacaaaactataatttgcaataaatcaaatagccttatttaaaaatctggaaataagttatattttaattaaaaggggcatttaaaaaatctgtaatcagaaatgttgattagcagaaagagaaggagtatgacatagtgaataattttttaaatagtaataaagttcaaattattgccaatagatggaaaattatgaacagactatgccagtatcagaaaaatataacctcagcttcatttactggaaataaaccagtctattttagtagattctttgttgctagccacaggaacttttgtaaagcttaatattttattctccttcttattccataaagctctttaatttttgatacgtgaaatgtgatcctgcaatccagggactttgcttttaactctcctattaatcacctctgatatcaaatacattcttctagttaagagagagagaacatttacactccaaaagctctcagaaactcagcaactttttttttaatagcatatctacttctccacttcattaatatacaggcttattcagctgcccagaactagtaatattacagtcttcagaatgactgtctaaatttagattctggcttagatcctagtgactacagggttccaggtcattcacagcctaatttgggtagaagttctactgtaataactatcctgattgtaattctaaaggtgttaacttttaagtaatggcatttcataggatatgttagggtctcgtgaataaatatctcagatgcaggatccactaattttttgtcttattcagaagctccgtgatagtaaaaagtctatattttttcttatatttgttctgcccagtaaacctttgtttggtgacttacatgtgagaaaggtgtaagtagaaaactgttgaataattctgaaacctagattctagaacaggtaaaaatgaatttgtaaatagaatgcttatttagtaagcattaaacacagatccatacctcattactaacttagacattgggcttgatctggaatttctggtaatctgctccaggtagtcagtcagaatatcagtaagtaatgagtatttattataggttctaattagtatggttttacagtttttctattgttgtaaaatatacataaaataaaatatacc

SEQ ID NO: 131952 - DNA, 2590 bp, Homo sapiens
  Payload ID: 5762
  Gene Symbol: FAM13A
  Gene Name: family with sequence similarity 13, member A
  Uniprot ID: O94988
  ENST ID: ENST00000513837
  CDS Start-End: 227-2236
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttctt

SEQ ID NO: 131953 - DNA, 1511 bp, Homo sapiens
  Payload ID: 5762
  Gene Symbol: FAM13A
  Gene Name: family with sequence similarity 13, member A
  ENST ID: ENST00000512339
  CDS Start-End: 187-639
cggaaagagaagcaaaaccactcttcctaaaatgttagaagctgctcttcgcttaccttggggcctttgcattgggagctgtttttcacatcaaagaatatgtgctgaatggaattttagtattttgctgtcgttttaatattttcgtctggtcttcctcagttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggtgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagttgactcacaagcacattacttttctgggaagaaacttttaagtggagaaaccttctactcctccacaatgaaaagaagctgtccagtaaacgaaatccctcctgcttcatgtccacttagcatggcagataattcgtactctacactctcctgtggaacagagagccttacagcttactgttgtatcatcacagttctatgatggcaatgtataaaaattaagattgaggcatgatattttaatgtcttttttattttcagtcacattaatttatcagggttaattagtgcctggtatcacatattttttttttttttggtgatgggttccttattcaatttttaaagattagaccatcttaaaatatttttagtgttgactgtgacaatttgttttttggctttcaaaacaaattattgtgtgttttaagtatgatgaccctagttttattggaggtatatatctacctccttttgcttttttatttgctaaactagctcatactgtatctcataaaaagtactttactatcttatttaaaactttgtaagtattttaatggctgggtaatcctttatcatgtgtatatgccataatttacgtatgatagtaatttggttatttagaatgcttacattttcattctattataaataaa

SEQ ID NO: 131954 - DNA, 1306 bp, Homo sapiens
  Payload ID: 5762
  Gene Symbol: FAM13A
  Gene Name: family with sequence similarity 13, member A
  ENST ID: ENST00000507352
  CDS Start-End: 201-692
agcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaag

SEQ ID NO: 131955 - DNA, 2762 bp, Homo sapiens
  Payload ID: 5762
  Gene Symbol: FAM13A
  Gene Name: family with sequence similarity 13, member A
  ENST ID: ENST00000509094
  CDS Start-End: 199-1032
atgtgggttcagcggaaagagaagcaaaaccactcttcctaaaatgttagaagctgctcttcgcttaccttggggcctttgcattgggagctgtttttcacatcaaagaatatgtgctgaatggaattttagtattttgctgtcgttttaatattttcgtctggtcttcctcagttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcatgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagtaagcaacttggtttttaattttcagtattgctataattttggacagaagattttatttaattctttctcataaaaattccatatggatataaccctcagattattattcctgtgtatagtgaatccttcttatgaaatctattattccaaatgcttattaaattgaaatatagccttctaaaattcaagaataatagcaattttatgttttcttgttgctataaagtcatctcaaaaacacttgcatgagcccagtgctctgatcaactggccgcaccacctttactacagaagcctgatgttacagcaggaataagtgcatatggctgtgatcaggagtgctaggttactaactagattgcaaattcctgaagacaatattactgtgtctttttgtctcttttgtgtctggcacaatttgaagcccaacctcagattctaagtcccatatattagtttttggtaacaatcatcagtaaaggagaatattttaaaaacctataaaggagtccttgacaatactatctaaatctttttatacattgataattttataatataccctgtatatattaggtaaatgcctgtaggtctccaaagacctagaattgagaatcagagggtaaacatccaaacaaatcccctagatgtgggaaaataaggaagttatcttatttcgtcgtcatttatattgaggtgaatcatgatggagctggtatgagatttcctcaggaggtttcttgaagcttatcaggtttacagaccataacatactctttgctgattcatatagcaatgaatgataaaatcagaggcacttggtttgggcacttaaaggaatgttttcatctcttctcccagttgaggccatgactttgaagaaaggttaaaatggtttgagtatcaagtagcatcctacaaaaggatctaaaactagattttctagtttgctcagttaaaatgataaaatgagataattggagactatcagttgtaaatctgagttagaaataacacggtagctgaaaaaaatgtcagtgattcacaagaaaaaataagaaaacaacattacttcagttttgcctcagaaaagttaaatgattttttaaatagaaaaaaatcgccctcaagtttgttcctctagtgcctatggtactttgaaaaggatctctttttaaaatgttaaaaggtaattaactttgtttcagcagcatctctcaatcacatataccccataaatatgtacaactattaaaggacctataatgataattaaaaataaaatattttaaaaatcttttataaacaatttttaacactcatacctttttactagggcagataaaataataaggtgaacctgaagtataatggaaatagataaatataatcttaggcagggcaaacttgctgagataaagctaattgctggaatatgccaatgggaagttgatatggtttggatgtttgtcccctccaaatctcatattgaaacgcagtccctggtgttggagctggggcctggtgggaggtgtttggatcatgagggcggatccttcgtgaatgacttagtgccatccccttggtgatgagtgagttcttgctgtgagttcacaggagacctgcttgtttaaaagtgtgtggcacttccccccctcactcttgctcccactctcgccatgtgatatgcctgctccccttcttcttctgccgtgattgtgagcttcctgaggcctcattagaggcagatgttctgtatggcctgctgaactgtgagtcaattaaacctctttttgaaataaa

SEQ ID NO: 131956 - DNA, 2287 bp, Homo sapiens
  Payload ID: 5762
  Gene Symbol: FAM13A
  Gene Name: family with sequence similarity 13, member A
  ENST ID: ENST00000504836
  CDS Start-End: 255-815
aacaaaaggtcaaagtggactgcagtgtaaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagtaatcaccaagactgtcagctgcctgcagttatcgggaagagcagcctggggaaagttaaaggagcacagatggacagttgctttctgcatgcaagtggccagctaggatccggggggcatcaagccatgatttttatttctgtgctggatgcattagcagctgtgacttggaaggttttatcctgaaggagtggaattgctgcagacgtcttggggttttggtgagcagtagatatttggggacattgtgctgttattgcagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattgaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatg

SEQ ID NO: 131957 - DNA, 3386 bp, Homo sapiens
  Payload ID: 5762
  Gene Symbol: FAM13A
  Gene Name: family with sequence similarity 13, member A
  Uniprot ID: O94988
  ENST ID: ENST00000503556
  CDS Start-End: 228-2279
taaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaa

SEQ ID NO: 131958 - DNA, 5465 bp, Homo sapiens
  Payload ID: 5763
  Gene Symbol: FAM13B
  Gene Name: family with sequence similarity 13, member B
  Uniprot ID: Q9NYF5
  ENST ID: ENST00000033079
  CDS Start-End: 453-3200
ccgcctctgtcgccactctctccccctgttccgcgtctgcgtcgccaccaccgccgggggtatccggggggtcgcttaccgggctggccccgcgccacagccgtagctttaacctcccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaa

SEQ ID NO: 131959 - DNA, 3214 bp, Homo sapiens
  Payload ID: 5763
  Gene Symbol: FAM13B
  Gene Name: family with sequence similarity 13, member B
  Uniprot ID: Q9NYF5
  ENST ID: ENST00000420893
  CDS Start-End: 507-3170
cccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctcccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaaggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattcc

SEQ ID NO: 131960 - DNA, 3098 bp, Homo sapiens
  Payload ID: 5763
  Gene Symbol: FAM13B
  Gene Name: family with sequence similarity 13, member B
  Uniprot ID: Q9NYF5
  ENST ID: ENST00000425075
  CDS Start-End: 670-3045
gcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctcccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagcgtcatgccctatcacttttcccctcattgatttcaaaacaatgcatctgcagagagatggggaggagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaaggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagcta

SEQ ID NO: 131961 - DNA, 590 bp, Homo sapiens
  Payload ID: 5763
  Gene Symbol: FAM13B
  Gene Name: family with sequence similarity 13, member B
  ENST ID: ENST00000509596
  CDS Start-End: 328-590
gtagcccatttacagatcatttcatagggtgttgatctaccggctgtcaaggagtccaaatggaagatctcaaagcccttaacagactataacaaagaagagattggctgaatattcatacccttattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaagga

SEQ ID NO: 131962 - DNA, 529 bp, Homo sapiens
  Payload ID: 5763
  Gene Symbol: FAM13B
  Gene Name: family with sequence similarity 13, member B
  ENST ID: ENST00000505961
  CDS Start-End: 373-529
atggtttactctctctgatgaaatgtgggagacactgtggcctctgtagcccatttacagatcatttcataggattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggccgggtgcggtggctaacgcctgtaatcccagcactttgggggccgagacgggcagatcacgaggtcaggagatggagaccatcctggctaacacgaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatg

SEQ ID NO: 131963 - DNA, 572 bp, Homo sapiens
  Payload ID: 5763
  Gene Symbol: FAM13B
  Gene Name: family with sequence similarity 13, member B
  ENST ID: ENST00000502471
  CDS Start-End: 287-572
gttttctggacgggaagaagagggtggtaaaaagcctaccatacttgccgactgaaagggacatctacagggctgagtgtttggattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctatta

SEQ ID NO: 131964 - DNA, 669 bp, Homo sapiens
  Payload ID: 5763
  Gene Symbol: FAM13B
  Gene Name: family with sequence similarity 13, member B
  ENST ID: ENST00000514310
  CDS Start-End: 244-669
actccatttcttggaagagccagcaatacatctctctaatgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagctt

SEQ ID NO: 131965 - DNA, 530 bp, Homo sapiens
  Payload ID: 5763
  Gene Symbol: FAM13B
  Gene Name: family with sequence similarity 13, member B
  ENST ID: ENST00000508403
  CDS Start-End: 338-530
gccgactgaaagggacatctacagggctgagtgtttggattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggccgggtgcggtggctaacgcctgtaatcccagcactttgggggccgagacgggcagatcacgaggtcaggagatggagaccatcctggctaacacgaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatg

SEQ ID NO: 131966 - DNA, 2088 bp, Homo sapiens
  Payload ID: 5764
  Gene Symbol: FAM13C
  Gene Name: family with sequence similarity 13, member C
  ENST ID: ENST00000435852
  CDS Start-End: 49-1770
actcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaaggtatgtgtcggcagagagatttttaaagctaatacttcctagagaattgctgttaaaaatgagctgcaattttttgcaggaacggtgactttttacaaaatgtatataatttccacactggcttagactcaggatttgtccaatgcaacattctaatagtgccagtattagggatgtttcatgggacatggtagctgtcaggtatgacatcaatctgtaaaaaataaaggataaactccaaaaatctctaactttgcacaataaatctcatcataaataaatgaatttatttaaacctttaaaaaaatctgttgatttttttagcccacataactgctttgttgttggtttcttagttccacaagttactccctaatttattaaataataattccttatttgcttt

SEQ ID NO: 131967 - DNA, 1963 bp, Homo sapiens
  Payload ID: 5764
  Gene Symbol: FAM13C
  Gene Name: family with sequence similarity 13, member C
  Uniprot ID: Q8NE31
  ENST ID: ENST00000422313
  CDS Start-End: 1-1377
atgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgtaagtcaggatacttgcatgctgttactttgtactgatgtgtagttaacaggatgtcacatagtagtacaagagttataaaagacccttcatggcagtatatactgcaaacaaggctagttgtcatttcaaaaagtgaaaatttggtcttctctaaccccattactatatttaacagtggctgatattagaactattgtaaaataggaacatatagcacttgtatgtctagagccaattttaacatttgctttcattatcttgggtgaaaagaaatgatagatttcagtttggcattttctaatttgtaacacagctagacaaaacagagcctttctgttctgtgtgttggttaattttttcctttaatcagaaaattaacaatatattcttgatataatgcaacatttgtttttggtaccatttgaccatactgtacaagatatgagaagatttatttcaatagaaaatataagtactgaaattgaattaggctacttttaataaagaatgatttatgggaatacagaactagaaaagcatcacaaatcctactccatcaatatcaaaacagttacttgttcaagatatcaatataaaaaggaataaatattaacaaatataaatttaa

SEQ ID NO: 131968 - DNA, 2110 bp, Homo sapiens
  Payload ID: 5764
  Gene Symbol: FAM13C
  Gene Name: family with sequence similarity 13, member C
  Uniprot ID: Q8NE31
  ENST ID: ENST00000468840
  CDS Start-End: 555-2063
aaaattggtaggagacatgtggaagaaagcaagtctcccgggtatttcagcacttcggcagaaacactggggcattctcattgccagcctcggggggtggctggcacaaagagcccaagattaaacgcggcgcctgggctggcgaggtcggggtcgtgtggtaactctccaggtgctcctcgctggatcccggggtcccagccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaag

SEQ ID NO: 131969 - DNA, 582 bp, Homo sapiens
  Payload ID: 5764
  Gene Symbol: FAM13C
  Gene Name: family with sequence similarity 13, member C
  ENST ID: ENST00000503444
  CDS Start-End: 567-582
attctcattgccagcctcggggggtggctggcacaaagagcccaagattaaacgcggcgcctgggctggcgaggtcggggtcgtgtggtaactctccaggtgctcctcgctggatcccggggtcccagccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagt

SEQ ID NO: 131970 - DNA, 459 bp, Homo sapiens
  Payload ID: 5764
  Gene Symbol: FAM13C
  Gene Name: family with sequence similarity 13, member C
  ENST ID: ENST00000512919
  CDS Start-End: 385-459
attcacagctctgtagtccggggctgggcgcttcctctctgggactgaaataagagcgctctagacagatcagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcag

SEQ ID NO: 131971 - DNA, 561 bp, Homo sapiens
  Payload ID: 5764
  Gene Symbol: FAM13C
  Gene Name: family with sequence similarity 13, member C
  ENST ID: ENST00000468696
  CDS Start-End: 1-405
agcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaaggtaaatcccagccaaagatcttttttcctcacaaaggaagcagttaaactagtgataatgtgctccagagcattttagattcatttccacctgtgccctcttgcaccttgttttctgcttagactgtaactcccttttgaaataaagcaccctgtatctctgtcattgtttggccccatgtaataaacctccttacaaagaaa

SEQ ID NO: 131972 - DNA, 3458 bp, Homo sapiens
  Payload ID: 5764
  Gene Symbol: FAM13C
  Gene Name: family with sequence similarity 13, member C
  Uniprot ID: Q8NE31
  ENST ID: ENST00000618427
  CDS Start-End: 469-1974
gtgcagacagcagcccaaggtagagcgagcgtgccgggcgagcccggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctattatattt

SEQ ID NO: 131973 - DNA, 3033 bp, Homo sapiens
  Payload ID: 5764
  Gene Symbol: FAM13C
  Gene Name: family with sequence similarity 13, member C
  Uniprot ID: Q8NE31
  ENST ID: ENST00000611933
  CDS Start-End: 135-1598
gtgcagacagcagcccaaggtagagcgagcgtgccgggcgagcccggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccgggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgatt

SEQ ID NO: 131974 - DNA, 3333 bp, Homo sapiens
  Payload ID: 5764
  Gene Symbol: FAM13C
  Gene Name: family with sequence similarity 13, member C
  Uniprot ID: Q8NE31
  ENST ID: ENST00000618804
  CDS Start-End: 91-1848
cggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctattatattta

SEQ ID NO: 131975 - DNA, 3388 bp, Homo sapiens
  Payload ID: 5764
  Gene Symbol: FAM13C
  Gene Name: family with sequence similarity 13, member C
  ENST ID: ENST00000614220
  CDS Start-End: 88-1908
agacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgagaattccttgctgaagctgcaagccctcgaatctgatctgtgctctgcatttttaacaaaccaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctattat

SEQ ID NO: 131976 - DNA, 585 bp, Homo sapiens
  Payload ID: 5764
  Gene Symbol: FAM13C
  Gene Name: family with sequence similarity 13, member C
  ENST ID: ENST00000489341
  CDS Start-End: 1-149
agaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattat

SEQ ID NO: 131977 - DNA, 3448 bp, Homo sapiens
  Payload ID: 5764
  Gene Symbol: FAM13C
  Gene Name: family with sequence similarity 13, member C
  ENST ID: ENST00000622363
  CDS Start-End: 131-283
agacagcagcccaaggtagagcgagcgtgccgggcgagcccggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctatt

SEQ ID NO: 131978 - DNA, 3400 bp, Homo sapiens
  Payload ID: 5764
  Gene Symbol: FAM13C
  Gene Name: family with sequence similarity 13, member C
  ENST ID: ENST00000621119
  CDS Start-End: 105-1922
gtgccgggcgagcccggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgagaattccttgctgaagctgcaagccctcgaatctgatctgtgctctgcatttttaacaaaccaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctatt

SEQ ID NO: 131979 - DNA, 596 bp, Homo sapiens
  Payload ID: 5764
  Gene Symbol: FAM13C
  Gene Name: family with sequence similarity 13, member C
  ENST ID: ENST00000619059
  CDS Start-End: 63-215
gtgtatgtgctctaactcccggagagcaatcagggagacggctccccggccagacttggctgatgttttcttgtttctgtttcagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcagaatacataccctactttaatgttctacaatttttgagccgaatgttacagccgattctaaacagagtgatgaagcttaaatgggcaaaggagacagagcatgtggtatccagccagtcagagtgt

SEQ ID NO: 131980 - DNA, 3677 bp, Homo sapiens
  Payload ID: 5765
  Gene Symbol: FAM131A
  Gene Name: family with sequence similarity 131, member A
  Uniprot ID: Q6UXB0
  ENST ID: ENST00000310585
  CDS Start-End: 1365-2372
gaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggccacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctccatctcctctgggtgctgggaaagtggaggattagctgaagttttgcttctcggggcctgtctgaatctccattgctttctgggaggacataattcacctgtcctagcttcttatcatcttacatttccctgtagccactgggacatatgtggtgttccttcctagctcctgtctcctcctcatgcctttgctgggtatgggcatgttagggggaaggtcattgctgtcagaggggcactgactttctaatggtgttacccaaggtgaatgttggagacacagtcgcgatgctgcccaagtcccggcgagccctaactatccaggagatcgctgcgctggccaggtcctccctgcatggtatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctcta

SEQ ID NO: 131981 - DNA, 2421 bp, Homo sapiens
  Payload ID: 5765
  Gene Symbol: FAM131A
  Gene Name: family with sequence similarity 131, member A
  Uniprot ID: Q6UXB0
  ENST ID: ENST00000340957
  CDS Start-End: 273-1118
ggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctc

SEQ ID NO: 131982 - DNA, 1483 bp, Homo sapiens
  Payload ID: 5765
  Gene Symbol: FAM131A
  Gene Name: family with sequence similarity 131, member A
  Uniprot ID: Q6UXB0
  ENST ID: ENST00000383847
  CDS Start-End: 180-1280
gccctggtgttcccacctcctcagagccatgaggcaggaatgttctccttatgtgactaggcacaggttccaaatggggaggggactggctcagcatccggagccaaaacaggaatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgccccc

SEQ ID NO: 131983 - DNA, 1335 bp, Homo sapiens
  Payload ID: 5765
  Gene Symbol: FAM131A
  Gene Name: family with sequence similarity 131, member A
  Uniprot ID: Q6UXB0
  ENST ID: ENST00000450976
  CDS Start-End: 427-1272
gtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgc

SEQ ID NO: 131984 - DNA, 1038 bp, Homo sapiens
  Payload ID: 5765
  Gene Symbol: FAM131A
  Gene Name: family with sequence similarity 131, member A
  Uniprot ID: Q6UXB0
  ENST ID: ENST00000453072
  CDS Start-End: 177-1022
ccgcagctgcgcggagcgccgggcacggatggcggcggctgaggggagcgaagcgagggagggagagcaagctaagaaacacccagcaggtgctcccccgcctaggcctggctggaggctactggcgccaccctgggggccctgtcagccaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctgg

SEQ ID NO: 131985 - DNA, 573 bp, Homo sapiens
  Payload ID: 5765
  Gene Symbol: FAM131A
  Gene Name: family with sequence similarity 131, member A
  ENST ID: ENST00000433578
  CDS Start-End: 204-573
ctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcagggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacag

SEQ ID NO: 131986 - DNA, 1664 bp, Homo sapiens
  Payload ID: 5765
  Gene Symbol: FAM131A
  Gene Name: family with sequence similarity 131, member A
  ENST ID: ENST00000418281
  CDS Start-End: 301-1056
accggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgtt

SEQ ID NO: 131987 - DNA, 812 bp, Homo sapiens
  Payload ID: 5765
  Gene Symbol: FAM131A
  Gene Name: family with sequence similarity 131, member A
  ENST ID: ENST00000418768
  CDS Start-End: 118-812
gttcaggaagtcatcaccttctcttgtcagggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccc

SEQ ID NO: 131988 - DNA, 4164 bp, Homo sapiens
  Payload ID: 5766
  Gene Symbol: FAM131B
  Gene Name: family with sequence similarity 131, member B
  ENST ID: ENST00000410085
  CDS Start-End: 1-35
ctgatttctcctgggacggcatcaacgcactgtgagcactcacgttctcaacctgtgccccagttttccagagcactggggatatatccctccttgggactcttggctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggc

SEQ ID NO: 131989 - DNA, 4286 bp, Homo sapiens
  Payload ID: 5766
  Gene Symbol: FAM131B
  Gene Name: family with sequence similarity 131, member B
  Uniprot ID: Q86XD5
  ENST ID: ENST00000409578
  CDS Start-End: 91-1137
agagcggctggggcggcggcgcggctcccggtgctccccccggcgcgcgccccgagtcggtgagggcccggctctgcggcccccggagccatgggctgcatcggctcccggactgtggggaatgaggtgattgcagtggattggaagggcctgaaggatgtcgatcaaatcaacatggacagcaccagctcactgcacgggagcagcctccatcggccatcgactgagctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggc

SEQ ID NO: 131990 - DNA, 4295 bp, Homo sapiens
  Payload ID: 5766
  Gene Symbol: FAM131B
  Gene Name: family with sequence similarity 131, member B
  Uniprot ID: Q86XD5
  ENST ID: ENST00000409346
  CDS Start-End: 148-1146
gcggagccgagcggagacagccgcggcgctgcagagcggctggggcggcggcgcggctcccggtgctccccccggcgcgcgccccgagtcgggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggc

SEQ ID NO: 131991 - DNA, 5856 bp, Homo sapiens
  Payload ID: 5766
  Gene Symbol: FAM131B
  Gene Name: family with sequence similarity 131, member B
  Uniprot ID: Q86XD5
  ENST ID: ENST00000409408
  CDS Start-End: 1710-2708
ggcggggcggggccggctctttatttacctttgacgcggggagggaagagaggcgcctcctaatccatcttctccctccagcttctgcctggctaccgcccctgacccccacccaggcacccactccactctcgccgctcagcgaattcatccggccctctcccaccccctcccccattcttcccctttccaactcccaatttctcccgcctacacctcccggtgacctcaggctgagagaataattcgtattattattacaaacaaactcactctccagaagcctgatttccctgagacccggtttatttccatggataccccctcctcctctgctttcaccccttctccgcggctctctccctccccgctgccccccacagctctgactcagctctccgtctctcacaaaggccacctcccgctcccctctccccccgcaccccgccctcccctgtctcccttctcctcaggctcttctccacctgccccattcctgctgtgtccggagggccatctttcctcttttcccccagtcaccaccccgcggagccccaggggacagcaggccaactttggagggtcctccctcctcagtccggttcaccacaagccccttcctttcccccagccctgctgatgtgctgaatgcctcctcgtgcccagccccattcaatgctccccttcccaaaaatggagccgacccctaaactcacaattgtaaaacctcatgagtataaagggcctgtacggtcagatggttcaggcagccatctgctgcttgaatagtccctttatgaagacccaagcagttcttccgcaagactctccgcggcaccatcctgccctcagtccaggagtctccctccaccaggagctctggcccggctgtaacaaggaccctccttcccctgagtcctgcagtttcccactcagccctcagaccctgtccacccctcccaccatcttctgtcttctctctgacttgaattcctattttcttaattcctattttaaaaagttctcttttctcctcctgctcaccagcttccctccactttaatccatcacttctctccccacagtcaggtgaaatgcctccagctcacccttggtttctctgctcactgtttttgggaggacacacccaactccttgctatccaactcctgcctcgattcccaggaagtcctcttccagtcagtcagactcatggactcttaggaagggcccaccgggggagacacatcccttccaccctaagcatagagaaaagttcctcatagagcagctctgcccttatctgtagacttgtaatagagaaaaagcccagctcccatacagaaaccctccaagagtcctcaggacggaataattggttttctgataaaacccaacctctgacccctccacataaacaacaacaaataaggccatacatcactttttctgagtgcactattctgggttgagctaaaactgaatatttgggctcagcattactacttgtctcccctagaatttggagagtgcagggatataagaggaaatgggcagctggggtaaggaaggggtgtgaagggctggccccagggtgtcgcctcggctgcacagggaggtgagggccggcggctaaccttctggccccctcagggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtgg

SEQ ID NO: 131992 - DNA, 3823 bp, Homo sapiens
  Payload ID: 5766
  Gene Symbol: FAM131B
  Gene Name: family with sequence similarity 131, member B
  Uniprot ID: Q86XD5
  ENST ID: ENST00000409222
  CDS Start-End: 97-1095
tttactgtcgttcctgcctcctccgattcgctttgttcacggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatct

SEQ ID NO: 131993 - DNA, 4382 bp, Homo sapiens
  Payload ID: 5766
  Gene Symbol: FAM131B
  Gene Name: family with sequence similarity 131, member B
  Uniprot ID: Q86XD5
  ENST ID: ENST00000443739
  CDS Start-End: 150-1232
ggggagggatggagaggggaggggggagcggagccgagcggagacagccgcggcgctgcagagcggctggggcggcggcgcggctcccggtgctccccccggcgcgcgccccgagtcggtgagggcccggctctgcggcccccggagccatgggctgcatcggctcccggactgtggggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggca

SEQ ID NO: 131994 - DNA, 597 bp, Homo sapiens
  Payload ID: 5766
  Gene Symbol: FAM131B
  Gene Name: family with sequence similarity 131, member B
  ENST ID: ENST00000519279
  CDS Start-End: 30-221
gagggcccggctctgcggcccccggagccatgggctgcatcggctcccggactgtggggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtccca

SEQ ID NO: 131995 - DNA, 729 bp, Homo sapiens
  Payload ID: 5766
  Gene Symbol: FAM131B
  Gene Name: family with sequence similarity 131, member B
  ENST ID: ENST00000521347
  CDS Start-End: 122-256
atctctctctccctctccgttgccttttactgtcgttcctgcctcctccgattcgctttgttcacggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctcgaatgctttttcctggaaaccatgaacctcctccatgtataaagcacgcccgtaccttcttattcctctgcccttcctcccacattcccatcccagctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcgtcatggagcagtttgctatctctgaggccacactcatggcctggtcttccatggatggtgaggacatgagtgtgaactccacccaggagccattgggctgcaactacagtgacaactaccaggaactgatggacagtcag

SEQ ID NO: 131996 - DNA, 1695 bp, Homo sapiens
  Payload ID: 5767
  Gene Symbol: FAM131C
  Gene Name: family with sequence similarity 131, member C
  Uniprot ID: Q96AQ9
  ENST ID: ENST00000375662
  CDS Start-End: 185-1027
gcgagccgggcgcggcggcagcagggacgacccaggctggagctgaggccgagctgagggcgcccgagccccccgccccgcccgtcctctggctccgcagcgctcagccccgggcccgcggagacatgaacgccccgcggccccacgcaccccgggcgcagcggcccggccccgcggccccgtgatgggctcctgcgtgtcgcgagacctgttcacaagtgcccacaagaactgccccatgccccagggtgcggaccccttgaacccagatctgccctcgggccgcactcccaccgtggctccagactgtgtcattggcaaggacaaacagatggatttctgttgggatccttggcagaggtgcttccagaccaccaacggctacctgtccgactccagatcccgccccggcaactacaacgtggcagccctggccacctcgtcccttgtgggggtggtgcagagcatcaaggaccacatcacaaagcccacggccatggcccgaggccgcgtggcccacctcatcgagtggaagggctggagtgcccagccggcaggctgggagctgtccccagctgaggacgagcattactgctgcctcccggatgagctgcgtgaggcccgctttgctgcaggggtcgccgagcagtttgccatcacagaggccacactgagcgcttggtcctcgctggacgaagaggagctgcaccccgagaacagcccccaaggcatcgtccagctccaagatctggagagcatctaccttcaggacagccttcccagcggcccctcacaggatgacagccttcaggccttctcctcgcccagcccctcccctgacagctgtccctcacctgaggagccccccagcaccgctggcatcccgcagccccccagcccagagctgcagcatcggcggcggctgcccggggcccaaggacccgagggtgggacccaccccccgggctccctcccctccatggacagcggctccctctgggaggaggacgaggtgttctataactgaggtgggggctgtgctggtccagcacctgctctcaccatgacctcgcctggtgggcagcccaggcatatctggaccccggggtccagggcagggcatcccttgacccctcgggtaggcacagggtaggtgcggcagggatggggccagtgctcatggtggcctctctgtgcctcggtggacctgccccagcagtgggagccataaccccctcccccttcattacttcactcaggtgggcaccttcccctgcagggtgtctgccctcagggaactcacggactctcagagacaccagggcagcctggcccagaggagcaacagccaggcccccaggaggacagccatggagagaactgagacccacttacagtggggtctgggaaccctgcctgtacctggggttcagtccctcccaactccctccttgtgtctgccccccagcaaaggtggggtgaccacttctggtagctaagcacctgctccccggctctcttcacccaggacatctgtctctctggagtgtctgtctgtctgtccctccctctctgaacctgcttcctccgtgtcccctgctcctcacccctgggagcccactccccctccttgcggctccctcccatctcactcaaggttctctgaggacattaaagtggtggattcaccctgga

SEQ ID NO: 131997 - DNA, 1036 bp, Homo sapiens
  Payload ID: 5768
  Gene Symbol: FAM132A
  Gene Name: family with sequence similarity 132, member A
  Uniprot ID: Q5T7M4
  ENST ID: ENST00000330388
  CDS Start-End: 33-941
ctcgccgcgctgagccgcctcgggacggagccatgcggcgctgggcctgggccgcggtcgtggtcctcctcgggccgcagctcgtgctcctcgggggcgtcggggcccggcgggaggcacagaggacgcagcagcctggccagcgcgcagatccccccaacgccaccgccagcgcgtcctcccgcgaggggctgcccgaggcccccaagccatcccaggcctcaggacctgagttctccgacgcccacatgacatggctgaactttgtccggcggccggacgacggcgccttaaggaagcggtgcggaagcagggacaagaagccgcgggatctcttcggtcccccaggacctccaggtgcagaagtgaccgcggagactctgcttcacgagtttcaggagctgctgaaagaggccacggagcgccggttctcagggcttctggacccgctgctgccccagggggcgggcctgcggctggtgggcgaggcctttcactgccggctgcagggtccccgccgggtggacaagcggacgctggtggagctgcatggtttccaggctcctgctgcccaaggtgccttcctgcgaggctccggtctgagcctggcctcgggtcggttcacggcccccgtgtccggcatcttccagttctctgccagtctgcacgtggaccacagtgagctgcagggcaaggcccggctgcgggcccgggacgtggtgtgtgttctcatctgtattgagtccctgtgccagcgccacacgtgcctggaggccgtctcaggcctggagagcaacagcagggtcttcacgctacaggtgcaggggctgctgcagctgcaggctggacagtacgcttctgtgtttgtggacaatggctccggggccgtcctcaccatccaggcgggctccagcttctccgggctgctcctgggcacgtgagggcgcccaggggggctggcgaggagctgccgccggatcccggggaccctcctactgatgcccgtggtcaccacaataaagagccctccaccctc

SEQ ID NO: 131998 - DNA, 612 bp, Homo sapiens
  Payload ID: 5769
  Gene Symbol: FAM132B
  Gene Name: family with sequence similarity 132, member B
  ENST ID: ENST00000344233
  CDS Start-End: 1-224
gcatccagtcccggtgccagcgcaacgcctccctggaggccatcatgggcctggagagcagcagtgagctcttcaccatctctgtgaatggcgtcctgtacctgcaggctacgaagaacctggtgcctcaggacctcctgggagccaagctggtctggcaagggcgctcaggcctgggagagaagggagcaatggccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaaggcctggtgcgattctcagtaggactcacacccaccctacctagaagtactgggctggcctgggtactgcatccgtgtgttttgataagggggtgatgtggccacgcccttatctagatttcactttgtatccactgggcacagatattctagagaacttatctttcactcttgtaaaagccacatatccacatctctttcatttttctcagtgtgttatgcagcaatttattaaagtatttattgtctaataaa

SEQ ID NO: 131999 - DNA, 2012 bp, Homo sapiens
  Payload ID: 5769
  Gene Symbol: FAM132B
  Gene Name: family with sequence similarity 132, member B
  ENST ID: ENST00000357303
  CDS Start-End: 1-191
gttttgggtacagctccctggaggccatcatgggcctggagagcagcagtgagctcttcaccatctctgtgaatggcgtcctgtacctgcagatggggcagtggacctccgtgttcttggacaacgccagcggctgctccctcacagtgcgcagtggctcccacttcagtgctgtcctcctgggcgtgtgagcggccaccacaggcccttcctctcaggggcaaatggagcacagatctagacaatgtgtggacagtgtcagagtagcagtggccacatggaggaggaggcccacccggaactctgcccacactggccactgcagttcagcccacagagccactgcaggcaggcctacggacgtgacacgcacgctggtggtcccggagccagggttgattcaggacaccatcttgggctcttatccaggaaagaaagagtcggcgtgcctgggggcacctgctagtctccagctgcaggccgactctttcctggcctgctcagcacctgcccagatggcctctgcgtctttcctgtgcccagccccaccttttccacctctcttcatgttctcatggagtgcaaagtgcaccagccagggcccctacctgggagagggtcagctgacgcagggctgagggggctgccacagggacgtacgctgtgtgttcttactgcttagaagggacggggtcactcaccactcccctggtctccatctgggctccttggtcttccctgcccctcccctaaccgtgttctacctgccagtggagctgagcactgcctagcctgggccagaggggcactggacaagggcctttgggggacagtaagtctgggcccagcttctagttctaatgtgtgcaagattaactcacaaattcacctcagaaggcctttccaaatgggagctccactcttcccctcctctgcaaatcttcacagccaaggccccttccaccctctccagaggtggatgagatcccttttcccctcccctctgaggtgctgactcactggtaggagccacccaccagaggaaagatctagaacgtctttacagattggagacagccgggcctgctgacccatcatccgaatagctgaagcagagtcttccaccaggggtgccagggcctggctgggtccagcggctctgggatgagcctcccaagcatctttcccacttgggtggccatgcggcgctgacattggacaggtggtggacgagagatggtcccgagaaagggtggtcttgggagggctggtcccaagcctgctgtgctcctgtggcagtgatggggcctggggatggggacggcagctctcatgaggacacacaggctgtgagcccgcagcctcctcaaatgtagcctcccacattttccccaaagtacaggactgtcccagagtaggtagtgaagaggacaaggccctcggcagcgacctccagggcctcctacctgctgaggaagagttaacccactgcctccccacacaacaggctacgaagaacctggtgcctcaggacctcctgggagccaagctggtctggcaagggcgctcaggcctgggagagaagggagcaatggccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaaggcctggtgcgattctcagtaggactcacacccaccctacctagaagtactgggctggcctgggtactgcatccgtgtgttttgataagggggtgatgtggccacgcccttatctagatttcactttgtatccactgggcacagatattctagagaacttatctttcactcttgtaaaagccacatatccacatctctttcatttttctcagtgtgttatgcagcaatttattaaagtatttattgtctaataaa

SEQ ID NO: 132000 - DNA, 1065 bp, Homo sapiens
  Payload ID: 5769
  Gene Symbol: FAM132B
  Gene Name: family with sequence similarity 132, member B
  Uniprot ID: Q4G0M1
  ENST ID: ENST00000546354
  CDS Start-End: 1-1065
atggccccggcccgccgccccgccggagcccgcctgctgctcgtctacgcgggcctgctggccgccgccgccgcgggcctggggtccccggagcctggggcgccctcgaggagccgcgcccgcagggagccgccgcccgggaacgagctgccccggggccccggggagagccgcgcggggccggccgctcgtccgccggagcccaccgctgagcgtgcacacagcgtcgacccccgggacgcctggatgctcttcgtcaggcagagtgacaagggtgtcaatggcaagaagaggagcaggggcaaggccaagaagctgaagttcggcttgccagggccccctgggcctcccggtccccagggccccccaggccccatcatcccacccgaggcgctgctgaaggagttccagctgctgctgaaaggtgcggtgcggcagcgggagcgcgcggagcccgaaccctgtacgtgtggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagcttggcgtctactacctgcccgacgccgagggtgccttccgccgcggcccgggcctgaacttgaccagcggccagtacagggcgcccgtggctggcttctacgctctcgccgccacgctgcacgtggcgctcggggagccgccgaggagggggccgccgcgcccccgggaccacctgcgcctgctcatctgcatccagtcccggtgccagcgcaacgcctccctggaggccatcatgggcctggagagcagcagtgagctcttcaccatctctgtgaatggcgtcctgtacctgcagatggggcagtggacctccgtgttcttggacaacgccagcggctgctccctcacagtgcgcagtggctcccacttcagtgctgtcctcctgggcgtgtga

SEQ ID NO: 132001 - DNA, 3292 bp, Homo sapiens
  Payload ID: 5770
  Gene Symbol: FAM133A
  Gene Name: family with sequence similarity 133, member A
  Uniprot ID: Q8N9E0
  ENST ID: ENST00000322139
  CDS Start-End: 438-1184
aaattgaatgaaaatggtccaaatggcgtcattgggtagtgtgactatggacgatttaaaaacaaaacgattttctctaaatattctatgagcatgcatttttacactggataaaaaaggggagagtcggttattggcagaggagggagggactagacagcaggcgtattgcattccacgaagctgatttaataagtgctgtctgtgatgtttggcaagcctggtttatatccatctacaaggtttgcgaacccatgttgccgatttttttttctgctacagaacaactcccttggtacaataaaaaagacgagtatttacttttcattgaaagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcatctgagtcctcatctgaatcagattatgaagaggatgtgcaagcaaaaaagaagagaaggtgtgaagagcgagaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaaatcccactgtgccagtaaggggcatagtggctgctggcaacttcaatatacatttttgtttgtttgcttgtccttccttctaatggttaattcctctgagagctaaaattctgttgtcataccagtgaataaaatgtttgaaattaaagtaaaatgtgttagataatgaataactttgacaaaaaaaagtgtatctaaggttaaatgtatctaattcgaatacatctttgaaatatcaccatcaatgaaacataaatgtaatttccagacaattgtagttggtatttttgatgcaaggacttaatattgatgtctcaaattccttgcttttgtaaataagtttagttcattttccttttttctttaatgaatctttgtttacatggggaaagagcatgtggggtgggaagggcaagtgtttgctaatcactgtggctagctgaatagtgtgcctttgactcttacacatcctatttttgccagagcagcagccgtccttttcttactttatgaaattctggggtgttgtatgctgcttcaagtgaacaagaaggacaggagtttacagcataagtaagcccccatatctatgaaatttacctcttcttcagcactgtttactatacagtactgaataatatttagtattacaatattacatgatttgaaataactttatacccattttgtatgggaaccattctaaacagaccctgatgttgtttgattaagaaatattctgaaattttttttgcatgttttatactgttaagttttaattatctgaccatattctatataactgatgatccttttttaagatatgatttatgcttaggatataagtttcaagtttttagtttcttagccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgttaaaccactgtga

SEQ ID NO: 132002 - DNA, 3159 bp, Homo sapiens
  Payload ID: 5770
  Gene Symbol: FAM133A
  Gene Name: family with sequence similarity 133, member A
  Uniprot ID: Q8N9E0
  ENST ID: ENST00000332647
  CDS Start-End: 314-1060
aagtgctgtctgtgatgtttggcaagcctggtttatatccatctacaaggtttgcgaacccatgttgccaacaactcccttggtacaataaaaaagacgagtatttacttttcattgaaagtggagaacctgaaaaggaacctggaaagaagcagctggaaaaggtgagaggaaaacctagagtgtgtgttatcctgcaagccaattgagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcatctgagtcctcatctgaatcagattatgaagaggatgtgcaagcaaaaaagaagagaaggtgtgaagagcgagaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaaatcccactgtgccagtaaggggcatagtggctgctggcaacttcaatatacatttttgtttgtttgcttgtccttccttctaatggttaattcctctgagagctaaaattctgttgtcataccagtgaataaaatgtttgaaattaaagtaaaatgtgttagataatgaataactttgacaaaaaaaagtgtatctaaggttaaatgtatctaattcgaatacatctttgaaatatcaccatcaatgaaacataaatgtaatttccagacaattgtagttggtatttttgatgcaaggacttaatattgatgtctcaaattccttgcttttgtaaataagtttagttcattttccttttttctttaatgaatctttgtttacatggggaaagagcatgtggggtgggaagggcaagtgtttgctaatcactgtggctagctgaatagtgtgcctttgactcttacacatcctatttttgccagagcagcagccgtccttttcttactttatgaaattctggggtgttgtatgctgcttcaagtgaacaagaaggacaggagtttacagcataagtaagcccccatatctatgaaatttacctcttcttcagcactgtttactatacagtactgaataatatttagtattacaatattacatgatttgaaataactttatacccattttgtatgggaaccattctaaacagaccctgatgttgtttgattaagaaatattctgaaattttttttgcatgttttatactgttaagttttaattatctgaccatattctatataactgatgatccttttttaagatatgatttatgcttaggatataagtttcaagtttttagtttcttagccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgttaaa

SEQ ID NO: 132003 - DNA, 1890 bp, Homo sapiens
  Payload ID: 5771
  Gene Symbol: FAM133B
  Gene Name: family with sequence similarity 133, member B
  ENST ID: ENST00000415397
  CDS Start-End: 39-356
tttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagcaagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtctta

SEQ ID NO: 132004 - DNA, 2434 bp, Homo sapiens
  Payload ID: 5771
  Gene Symbol: FAM133B
  Gene Name: family with sequence similarity 133, member B
  Uniprot ID: Q5BKY9
  ENST ID: ENST00000438306
  CDS Start-End: 232-945
ggcggagtggggaggcggcaagaggacctgcggcaggccctcttcggcagtctctccggcccggtttccctcggcgtgctactgtgcgctcgatccagcaccatggggaagcgggacaatcgggtggtactgccaaaattatgacatgataccaaggaaattagaatgtgatcaatattgttgaaaacaaaaacaaaaacctgagaccagttaaatttaacaaaggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaa

SEQ ID NO: 132005 - DNA, 2026 bp, Homo sapiens
  Payload ID: 5771
  Gene Symbol: FAM133B
  Gene Name: family with sequence similarity 133, member B
  Uniprot ID: Q5BKY9
  ENST ID: ENST00000445716
  CDS Start-End: 104-847
aggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaa

SEQ ID NO: 132006 - DNA, 931 bp, Homo sapiens
  Payload ID: 5771
  Gene Symbol: FAM133B
  Gene Name: family with sequence similarity 133, member B
  Uniprot ID: Q5BKY9
  ENST ID: ENST00000427372
  CDS Start-End: 218-931
cttgcccgccccttttttcttccctcacctcgtcgctctttctggcgctgctggtttgcactcttgcctgctgtacgcgggcccccagtgcccacttagaaccgcgagggctcggggaaccccccccacacctggccccgccatgtaactccgaagacttaggcccttggacgcatccgactcacccgccccttggtatcggccgccccaggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataa

SEQ ID NO: 132007 - DNA, 253 bp, Homo sapiens
  Payload ID: 5771
  Gene Symbol: FAM133B
  Gene Name: family with sequence similarity 133, member B
  ENST ID: ENST00000456502
  CDS Start-End: 162-253
tctggcgctgctggtttgcactcttgcctgctgtacgcgggcccccagtgcccacttagaaccgcgagggctcggggaaccccccccacacctggccccgccatgtaactccgaagacttaggcccttggacgcatccgactcacccgccccttggcctatatgaacccaatagcaatggcgagatcaaggggtccaatccagtcttcagggccaacaatacaggattatctgaatcgaccaaggcctacctg

SEQ ID NO: 132008 - DNA, 854 bp, Homo sapiens
  Payload ID: 5771
  Gene Symbol: FAM133B
  Gene Name: family with sequence similarity 133, member B
  ENST ID: ENST00000494079
  CDS Start-End: 1-363
tattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagcaagtatctcttaacgtttttacagacaatagaataggtgttttggtttaatataaaatgagtcatggtaaagcttgattggatttactgggaccaaataagtatttgttgggaaaggtgtggtgtgttcagcagcttcacttaatgggtaggagaaagtcaaaatggttcaggaaaaataaaaaataccctggtagcaagcatgtcctgtttccatttcagtattttactgttagaaatataagctcagggctgggcgctgtgtctcacgcctgtaatcccagcactttgagaggctgaggcaggtggatcatgaggtcaggagctcgagaccatcctggctaacacggtgaaaccccgtctctactaaaaatacaaaaaattagccgggcatggtggcgggcacctatagtcccagctactcgggaggctgaggcaggagaatggcgtgaacccgggaggcagagcttgcagtgagctgagatcacgccactgcactccagcc

SEQ ID NO: 132009 - DNA, 2533 bp, Homo sapiens
  Payload ID: 5772
  Gene Symbol: FAM134A
  Gene Name: family with sequence similarity 134, member A
  ENST ID: ENST00000273048
  CDS Start-End: 127-663
agtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaa

SEQ ID NO: 132010 - DNA, 729 bp, Homo sapiens
  Payload ID: 5772
  Gene Symbol: FAM134A
  Gene Name: family with sequence similarity 134, member A
  ENST ID: ENST00000452022
  CDS Start-End: 448-729
ggggcatgacccatccccagtttttgcaggctgacatccgcttgaattgcccatttttttctatctctgagtcgtgagtcgcgagttaggcctggaggtgccattaccccatcagtaggcgcctttccaccttctgagatggatgcatgagcctgtctcacccactcactgctgaggtgcctgtctctccctaaggttgctgtcttcctcgtccctccggcccttcttcctactcagcgtctcacttttggcctattttctgctggatctctggcagcctcgctttctccctgacgtttcagcatcatccccagaggagccacactctgacagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattg

SEQ ID NO: 132011 - DNA, 609 bp, Homo sapiens
  Payload ID: 5772
  Gene Symbol: FAM134A
  Gene Name: family with sequence similarity 134, member A
  ENST ID: ENST00000452293
  CDS Start-End: 77-385
tccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctgcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtct

SEQ ID NO: 132012 - DNA, 4618 bp, Homo sapiens
  Payload ID: 5772
  Gene Symbol: FAM134A
  Gene Name: family with sequence similarity 134, member A
  Uniprot ID: Q8NC44
  ENST ID: ENST00000430297
  CDS Start-End: 137-1768
agcgctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctctttggggaagaaaagcccagaactgagcagatggcctcctttatgagttcatgtcctccgccttcagctggaggtaccatatggcgatgctacctgtctttctgctggaggtaccatatggtaatgctgcctggctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatgactgcaacatgtcctatctttaatctattttcttattaagcttggacattgacaatagaaccagaagcttgtagctggatcaaaatattctccataggcctggagtttcatgagggtctattcttttgttgttgttgttttggttttttgttttttgtgggtttttttttttttttttttgagacggagtcttgttctgttgcccaggctggagtgcaatggtgcagtcttggttcactgcaacctctgcctcccaggttcaaacaattctcctgcctcagccgtccaagtagctgggattacaggtgcatgccacgatgcctggctattttttgtatttttagtagaggtggggtttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctccaaaacaagaaa

SEQ ID NO: 132013 - DNA, 563 bp, Homo sapiens
  Payload ID: 5772
  Gene Symbol: FAM134A
  Gene Name: family with sequence similarity 134, member A
  ENST ID: ENST00000430747
  CDS Start-End: 549-563
atcacttggcctgggggcatgacccatccccagtttttgcaggctgacatccgcttgaattgcccatttttttctatctctgagtcgtgagtcgcgagttaggcctggaggtgccattaccccatcagtaggcgcctttccaccttctgagatggatgcatgagcctgtctcacccactcactgctgaggtgcctgtctctccctaaggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacatt

SEQ ID NO: 132014 - DNA, 992 bp, Homo sapiens
  Payload ID: 5772
  Gene Symbol: FAM134A
  Gene Name: family with sequence similarity 134, member A
  ENST ID: ENST00000458520
  CDS Start-End: 491-992
gccaccgggctggagagctcctccaggctacagtcggcttcccagtcccagccatagtagagcctccttcggatccgggcactcagcttctggtgtcctgggaggaactgaaacagggcaggggcagcggagggtgaagggcacggaaaggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtc

SEQ ID NO: 132015 - DNA, 1781 bp, Homo sapiens
  Payload ID: 5772
  Gene Symbol: FAM134A
  Gene Name: family with sequence similarity 134, member A
  ENST ID: ENST00000420189
  CDS Start-End: 1-610
agactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaa

SEQ ID NO: 132016 - DNA, 558 bp, Homo sapiens
  Payload ID: 5772
  Gene Symbol: FAM134A
  Gene Name: family with sequence similarity 134, member A
  ENST ID: ENST00000443757
  CDS Start-End: 543-558
cttcccgagcgagcagaagcagaccctaccggggatactgggaatctggaagcccacttcctgccccacacggggataccggggcagcaccacactccctagccgccctgcctactgtgggataagaaaacgggctcgactgcctggacctagacccggactcggaacccggggtacttcgtcaaccagaaaacgaacctgtgttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattg

SEQ ID NO: 132017 - DNA, 3268 bp, Homo sapiens
  Payload ID: 5773
  Gene Symbol: FAM134B
  Gene Name: family with sequence similarity 134, member B
  Uniprot ID: Q9H6L5
  ENST ID: ENST00000306320
  CDS Start-End: 88-1581
accgccgccccgccctcggcggcacccacacccaggcgcgcccgcgcgcgcgcccggccccgtccctgtctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaa

SEQ ID NO: 132018 - DNA, 3145 bp, Homo sapiens
  Payload ID: 5773
  Gene Symbol: FAM134B
  Gene Name: family with sequence similarity 134, member B
  Uniprot ID: Q9H6L5
  ENST ID: ENST00000399793
  CDS Start-End: 387-1457
atccaatgaaggttactggctgagcggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccaactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaa

SEQ ID NO: 132019 - DNA, 1054 bp, Homo sapiens
  Payload ID: 5773
  Gene Symbol: FAM134B
  Gene Name: family with sequence similarity 134, member B
  ENST ID: ENST00000510362
  CDS Start-End: 1-653
gtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 132020 - DNA, 3759 bp, Homo sapiens
  Payload ID: 5774
  Gene Symbol: FAM134C
  Gene Name: family with sequence similarity 134, member C
  Uniprot ID: Q86VR2
  ENST ID: ENST00000309428
  CDS Start-End: 61-1461
agttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaacaa

SEQ ID NO: 132021 - DNA, 565 bp, Homo sapiens
  Payload ID: 5774
  Gene Symbol: FAM134C
  Gene Name: family with sequence similarity 134, member C
  ENST ID: ENST00000593251
  CDS Start-End: 52-441
tattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcg

SEQ ID NO: 132022 - DNA, 564 bp, Homo sapiens
  Payload ID: 5774
  Gene Symbol: FAM134C
  Gene Name: family with sequence similarity 134, member C
  ENST ID: ENST00000591547
  CDS Start-End: 205-564
gacctgggagaatccgctggcccagttgttgccagctcctcctccatgttccgacagagatgtaacctagaagtcaagcggtaaaacaagctttgcaactatgtggatggacaagatgtaattgaagatgaagtactttagagatggtatgggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtg

SEQ ID NO: 132023 - DNA, 522 bp, Homo sapiens
  Payload ID: 5774
  Gene Symbol: FAM134C
  Gene Name: family with sequence similarity 134, member C
  ENST ID: ENST00000585726
  CDS Start-End: 61-312
agttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctgttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaat

SEQ ID NO: 132024 - DNA, 409 bp, Homo sapiens
  Payload ID: 5774
  Gene Symbol: FAM134C
  Gene Name: family with sequence similarity 134, member C
  ENST ID: ENST00000590541
  CDS Start-End: 1-246
atggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggtattaggagataggagtacaaaaaaaaacccatcagaattcagagatgtaacctagaagtcaagcggtaaaacaagctttgcaactatgtggatggacaagatgtaattgaagatgaagtactttagagatggtatgggttttttgccctgacatctcttcgtcttgtg

SEQ ID NO: 132025 - DNA, 1632 bp, Homo sapiens
  Payload ID: 5774
  Gene Symbol: FAM134C
  Gene Name: family with sequence similarity 134, member C
  ENST ID: ENST00000586870
  CDS Start-End: 63-464
gcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctca

SEQ ID NO: 132026 - DNA, 4149 bp, Homo sapiens
  Payload ID: 5774
  Gene Symbol: FAM134C
  Gene Name: family with sequence similarity 134, member C
  ENST ID: ENST00000589797
  CDS Start-End: 54-296
gttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggtgagagaactggaccctcggaaaccctccgagtcccgaattcgttggttcctctagggctctacttctcgcctgccctgttttcttcgctgcactggctccttcctgtacttgcctaattttgcctcacctccttccactccatcccgcctgcaggcttcggcaccctagttcttcccagggccgtccacccatcttctctgccttacctgtgcccgcacccccgccccgcacatctggcgggagcttctggtaacatcttgagccgctcaagagtgagcgagggctcctcttttgagcccgacaaagctgcgtccctttaaagccatcacttcctttctcttgtctgctcaagtgcaagttctagattgtttccagaggttttagtagtttattgttggagtagaggcgtgaagtcttgcaaaggttttttgccctgacatctcttcgtcttgtgtttttacttgcatttggcttgatgatcattgtgtgtattgatcaatggaagaacaaaatctggcctgaaataaaagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaacaatc

SEQ ID NO: 132027 - DNA, 559 bp, Homo sapiens
  Payload ID: 5774
  Gene Symbol: FAM134C
  Gene Name: family with sequence similarity 134, member C
  ENST ID: ENST00000588423
  CDS Start-End: 233-559
aataggaaacgacctgggagaatccgctggcccagttgttgccagctcctcctccatgttccgacaggcaccggcgttgcagccgctcccgcccgcaacggcgccgcacgccagcccgctcgccgcaagacgcaggcgccaaacaaccagctccacccacgaacttcctccgctccaatgagaatcgagttctggcaatgaatggcacgtctttaagcactggccttcgttcatgcagattgcgcgtgcgcggctccggatgcggctcggcgcctccggatccggctccgcgcctcagttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggc

SEQ ID NO: 132028 - DNA, 1733 bp, Homo sapiens
  Payload ID: 5774
  Gene Symbol: FAM134C
  Gene Name: family with sequence similarity 134, member C
  ENST ID: ENST00000585894
  CDS Start-End: 140-1249
agttgtgggccctgccagggaataggaaacgacctgggagaatccgctggcccagttgttgccagctcctcctccatgttccgacaggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcag

SEQ ID NO: 132029 - DNA, 5198 bp, Homo sapiens
  Payload ID: 5775
  Gene Symbol: FAM135A
  Gene Name: family with sequence similarity 135, member A
  ENST ID: ENST00000194672
  CDS Start-End: 45-488
cagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggccaaggccaacatgcagctcctatatgagcgtcttctcagaagaaaacagctacgaacacagaaagacaaccatctagaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagcta

SEQ ID NO: 132030 - DNA, 5042 bp, Homo sapiens
  Payload ID: 5775
  Gene Symbol: FAM135A
  Gene Name: family with sequence similarity 135, member A
  Uniprot ID: Q9P2D6
  ENST ID: ENST00000361499
  CDS Start-End: 345-4304
ctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttgg

SEQ ID NO: 132031 - DNA, 5930 bp, Homo sapiens
  Payload ID: 5775
  Gene Symbol: FAM135A
  Gene Name: family with sequence similarity 135, member A
  Uniprot ID: Q9P2D6
  ENST ID: ENST00000370479
  CDS Start-End: 134-4681
ggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagct

SEQ ID NO: 132032 - DNA, 5282 bp, Homo sapiens
  Payload ID: 5775
  Gene Symbol: FAM135A
  Gene Name: family with sequence similarity 135, member A
  Uniprot ID: Q9P2D6
  ENST ID: ENST00000457062
  CDS Start-End: 271-4179
tgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggccaaggccaacatgcagctcctatatgagcgtcttctcagaagaaaacagctacgaacacagaaagacaaccatctagaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggtt

SEQ ID NO: 132033 - DNA, 6415 bp, Homo sapiens
  Payload ID: 5775
  Gene Symbol: FAM135A
  Gene Name: family with sequence similarity 135, member A
  Uniprot ID: Q9P2D6
  ENST ID: ENST00000418814
  CDS Start-End: 615-5162
gctggaggggcagttgaagctcctgaagggcggggcacggagcttgaaggggcggggcctagcctcagagaggggagggaagaggcgggaggaggaggtgagagaggccgggggcggggccgtgcggccggggacctgttgatcgcaggtatagccggctggcccgggctccctcgggactggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaa

SEQ ID NO: 132034 - DNA, 546 bp, Homo sapiens
  Payload ID: 5775
  Gene Symbol: FAM135A
  Gene Name: family with sequence similarity 135, member A
  ENST ID: ENST00000515280
  CDS Start-End: 454-546
gcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagattcgagtatttgccaaatttctatgaagaactgcttcaagaattgggaagggtctgagattttaccccacttgcaagctgacaagttagtctgccacggtgccatggatgttggcaggacatgagagtcatggatcaaggtgctgttatcagaatagtcttctgggtataaattaaaaatgactgaagttcaagcaatggtagaattctctgtggagctaaacaagttctacaatgtggatttgtttcagagaggtttttaccagattcgt

SEQ ID NO: 132035 - DNA, 1926 bp, Homo sapiens
  Payload ID: 5775
  Gene Symbol: FAM135A
  Gene Name: family with sequence similarity 135, member A
  ENST ID: ENST00000515323
  CDS Start-End: 412-1926
ggccgtgcggccggggacctgttgatcgcaggtatagccggctggcccgggctccctcgggactggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaac

SEQ ID NO: 132036 - DNA, 5173 bp, Homo sapiens
  Payload ID: 5775
  Gene Symbol: FAM135A
  Gene Name: family with sequence similarity 135, member A
  Uniprot ID: Q9P2D6
  ENST ID: ENST00000505868
  CDS Start-End: 1-4410
atgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggtaatggaataaaattatttcaaagagttataggtattaatgagctctttccaaaatttttcttgtagtcactttctctcgtatctgtcacccttctctttcctgttacttcctttccacccacttatattaacagctgtcctttttccattcttctcacctgccacgtgaactgcctttaccaatgaagtaatactttcatctaattacaaatgcctctccattttgctgcctcagaagtagttcatactttgatttcctctgaattaatgggattgacaattgtagtcatccttgtcatatgttctgctgtacctcgcttttacgcaaaggtggcagcaaggatttgcccctctttactgatagtaaatgataaagactttatttgttcttttgctatttgtgaataacaaaataaatttaaagtatagccatttggagccagaaggaaacttgagtcctgtttactcattttataactaaagcccagagatactaagtggcttagcccgaatcagttaattacagacttaggtcaagaacctggtctccgggcgtggtggctcctgcctgtaatcccagtactttgggaggccaaggcaggtagatcacctgaggtcaggagttcgagaccagcctggccaacatggtgaaaccccgtctctactaaaaatacaaaaattagccgggcgtgatggcgggtacctgtaatcccagctacttgggaggctgaggcacgagaatagcttgaacccgggagggaaaggttgcagtgagccaagatcatgctgttgcactgcagcctgagagacaagaacgaaactctgtctc

SEQ ID NO: 132037 - DNA, 4806 bp, Homo sapiens
  Payload ID: 5775
  Gene Symbol: FAM135A
  Gene Name: family with sequence similarity 135, member A
  ENST ID: ENST00000505769
  CDS Start-End: 408-3695
gcggggccgtgcggccggggacctgttgatcgcaggtatagccggctggcccgggctccctcgggactggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatgatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaa

SEQ ID NO: 132038 - DNA, 641 bp, Homo sapiens
  Payload ID: 5775
  Gene Symbol: FAM135A
  Gene Name: family with sequence similarity 135, member A
  ENST ID: ENST00000507085
  CDS Start-End: 491-641
ggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcaggctggagtgcagtggtgtgatctcagctcactgcaacctcctcctcaagggttcaagcgattctcctgcctcagcttcctgagtagctgggattacaggcccgtgccatcacacccagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatg

SEQ ID NO: 132039 - DNA, 558 bp, Homo sapiens
  Payload ID: 5776
  Gene Symbol: FAM135B
  Gene Name: family with sequence similarity 135, member B
  ENST ID: ENST00000160713
  CDS Start-End: 100-558
agaggtgctttctctctggacagttttatgaatacataaggaggttctgtccccactcccttcgcaaccgcatcttattggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccg

SEQ ID NO: 132040 - DNA, 4288 bp, Homo sapiens
  Payload ID: 5776
  Gene Symbol: FAM135B
  Gene Name: family with sequence similarity 135, member B
  Uniprot ID: Q49AJ0
  ENST ID: ENST00000276737
  CDS Start-End: 172-3597
aacaccagctcgcaggtgctgcggactccccagtccgcccgccgccgccgccgccgcaactgttggcggccagagacggcgaaagaggagagagagggacccaggagcgcggcccccgggggagagagaggggagccctgcagtggagacaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaggccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttataaggtgtccagagccaggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtgctgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattagcttcattggccattctcttggcaacatcatcatccgatcggtcctcacacggccccggttccggtattacctcaacaaactccacacgttcctgtcactctctgggcctcacctgggaaccctgtacaacaacagcaccctggttagtacaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtag

SEQ ID NO: 132041 - DNA, 6962 bp, Homo sapiens
  Payload ID: 5776
  Gene Symbol: FAM135B
  Gene Name: family with sequence similarity 135, member B
  Uniprot ID: Q49AJ0
  ENST ID: ENST00000395297
  CDS Start-End: 172-4392
aacaccagctcgcaggtgctgcggactccccagtccgcccgccgccgccgccgccgcaactgttggcggccagagacggcgaaagaggagagagagggacccaggagcgcggcccccgggggagagagaggggagccctgcagtggagacaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaggccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttataaggtgtccagagccaggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtgctgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagtttttatcaggccaaagaaaaatttaaaaaagaactgaagattgaaggatttctgtacagtgacttaactgtactagcttctgatataccatatttcccaccagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattagcttcattggccattctcttggcaacatcatcatccgatcggtcctcacacggccccggttccggtattacctcaacaaactccacacgttcctgtcactctctgggcctcacctgggaaccctgtacaacaacagcaccctggttagtacaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtagtggctttgagggagcaggtctttggtaatgcttacgatcggtggagagctttagctgagacctgcttttacagacctcaccatttcagaatgaagcttcaacagcattgggggacggaggctcgggtggaacctgacatgagaggtgcttttgttttggagattcgagaaagctgagcaaatagactaaatgacaacaaactttgcttgaatttgtatagttacctggagtgtcattcaagatgttttctaggaaaaatatgagagaataaacagaatacttgggagttggtgagctccccttgctagccactactggcttactgagagattactccaatttaactagacttgccgaatatgttactagcttatagctttatcatttctgattaagtgcacacaagcatttcagaactcaggttaatctctgtgcagcagtggaacatatttgtgtaaatagaatcctcaatagattcaaatgtgtcagttgttcaagaaaatgtgatgcccatattcatattctctcctcatgttttctaaacaagggagcaaggaatgtgttacaaatcccagttctatttcataacagcagtgagcagggtgacttaaggtaaagagggataaaggtgacactattggtaaatacaagtttgttacaaagaaacatgactctagggacatactgaactatgaatagttgctccacctacttccccagaattcttctatgcagagccctgatccacaaattattttagtgattgcttacatctttgtctgtagtagggaacactgagtgagactaacctagcagaagggggcactgagatgaatgcacacacgtgtgaagctcctgctgatacacttccaaagacatgctatgttagcatttgatgcaattgcaaaaaattaaatccattaaagtggccagctgcttctcctctccatggaaggaggaaaacatctaaatggaggagtgctggattaaaacctcaggggagctctaagaagggtgctggctatctttcaatagaaatgtcttcttgccttaggaaaataaagggctaggaaaggtcactgcgttgataaaaaccaatagacgacagggacaaaagtgagatcagataggaggagaacaaccagactgaagactcaacataagctgttattggtaagtgactcaaaggggagttttgaaaattaccaggatgtttaatagtcaggtctcaaagactgagtatgttgtatgggctaaagtaagcctaaagaatcatttcgttgtatggaagagatgaatgaacctggacagtagggataagtaagacaggagcctaatcttttggagatgaaagctcctgcttctgcaaaaatcccttctgaagtgtggaaacgcatctaggaccagggttctcaatacctagaccatgactctaggtcactgatgccatggtaacaaaaccaagtaaatctaagctcatttgagaattttagatcctcttatgttaacaatgtgactttgaaaaataaaagcagaccatgggaatgagtccagatgggcagctttgcaggagtgtagacatgtggtattcttttgaagaaagagagggtcgttgagggagagttgaatgtcttgcaaaggcagagttccacacaatggatttagggtttctcagtgagtcctttctaaatgcttgttatatcctggtcataatgcatatgggttcactgagtcctctggtcactttccactggggatttttatctgagctcccgagtcagagctgggcatagactctggttcttcatgaggagtgctgtatttgctctgtaacctgggagacatttgttccctagtcgtgcagcacatggtattgtgtttcctgacctaggcaagtgcccatgctcagtacagaaccataagttggtagcagcttctcctttctggccaaatgatgggccctgtccctctgatgagtgcatttcatgttgtgtttccaattttcatcagcaatgttcgtcattccctggtcctttgaaagactgtgtagcccgcggttatggagccgggatgaatctgatgatcatcatcttctccaataaccagatgccatttttaacttcaatatgctgtctggacatagtgagaactaatggcaataaacgtccagctgcatggtgcacctcttttttataggggtgctctgctgtctttgtaaaccctctctggcctctgagcatctattataattgtgtagaaagtacatctctatattgtaaataagagtgtcgagtgttgcgtgtcatgcctcatttgaaaaggcttttttatgtctctttctattgaaatatagatatcgaatatataaatatatatacataaaatatatataaatatatattatgtaaaacagggacattctattattgattgtaaaaattataaacaaaatgcctgccaagataatggtcttgtatgtcttcattctctgcgtaatttttgtttttgtttttatgatttgttgtttcccaaaatgagttagaaataaaaatgcccaatattgagattaa

SEQ ID NO: 132042 - DNA, 684 bp, Homo sapiens
  Payload ID: 5776
  Gene Symbol: FAM135B
  Gene Name: family with sequence similarity 135, member B
  ENST ID: ENST00000520380
  CDS Start-End: 479-684
attgaatcaatacagcctgtgtttctcatgatcgcctggtccttgagactgttgataaggcattagagagcttcatggttgttgataatctgaggaacgccctctctagtgacagactgtcacggacatggaggattttttgaagtgccttttcaattttatgagttgaggatcctgcagccctggagatttataattgtccctgccactgctgctttgtgccttcttctagtttctgccttgtttatctggttttcttcccccatagtattttggcaattgtgaaaagtggttctggagaagtaccaacaaatgctcttactgcccgagaactgacacttttggaggctactgatgtttacggcaaaatagcctgagtcctttaatgtccttctttgattgttctaccagctacgattcctgcaaatccctgtcattcttcatcacaaagttatagaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagaggttctaaatatacatatgtcagaacaagaaccagcacaaggtaagta

SEQ ID NO: 132043 - DNA, 4734 bp, Homo sapiens
  Payload ID: 5776
  Gene Symbol: FAM135B
  Gene Name: family with sequence similarity 135, member B
  ENST ID: ENST00000482951
  CDS Start-End: 125-256
ggagctcttcacccagtgtagggtatggtttgtgaaggtatccctagagaaggtgactctgcggctgagcttgaaggaagagaattggtaggtgacaaagaagaggtaatgagccaaaaagatcatgtctgaaatacaaggaacggttgagttttcggtagagctacataaattttataatgtggatctctttcagagagggatgcagtctgaatttggcatttcacgtgcaggtgatatcagtaaatcctcatgatagacttacctccaaggctcattgtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaggccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttataaggtgtccagagccaggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtgctgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagtttttatcaggccaaagaaaaatttaaaaaagaactgaagattgaaggatttctgtacagtgacttaactgtactagcttctgatataccatatttcccaccagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattagcttcattggccattctcttggcaacatcatcatccgatcggtcctcacacggccccggttccggtattacctcaacaaactccacacgttcctgtcactctctgggcctcacctgggaaccctgtacaacaacagcaccctggttagtacaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtagtggctttgagggagcaggtctttggtaatgcttacgatcggtggagagctttagctgagacctgcttttacagacctcaccatttcagaatgaagcttcaacagcattgggggacggaggctcgggtggaacctgacatgagaggtgcttttgttttggagattcgagaaagctgagcaaatagactaaatgacaacaaactttgcttgaatttgtatagttacctggagtgtcattcaagatgttttctaggaaaaatatgagagaataaacagaatacttgggagttggtgagctccccttgctagcca

SEQ ID NO: 132044 - DNA, 1616 bp, Homo sapiens
  Payload ID: 5776
  Gene Symbol: FAM135B
  Gene Name: family with sequence similarity 135, member B
  ENST ID: ENST00000467365
  CDS Start-End: 1-1356
gagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattaggtaaaaggaaaccacaggtagttaatgctgggggaagaggggggacatttttgagtgtttgctgtataaaagcaataatatgatgccttctgtataccactgagctaagctaacttgtgacttttaataaattacttttaaagcagaagtaa

SEQ ID NO: 132045 - DNA, 1810 bp, Homo sapiens
  Payload ID: 5777
  Gene Symbol: FAM136A
  Gene Name: family with sequence similarity 136, member A
  Uniprot ID: Q96C01
  ENST ID: ENST00000037869
  CDS Start-End: 80-496
gggcggtgagggggcgggcccgtacgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctttcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctccccac

SEQ ID NO: 132046 - DNA, 518 bp, Homo sapiens
  Payload ID: 5777
  Gene Symbol: FAM136A
  Gene Name: family with sequence similarity 136, member A
  ENST ID: ENST00000438759
  CDS Start-End: 29-518
gctccgggtgcaggaggcggtggagtccatggtgaagagtctggaaagagagaacatccggaagatgcaggtagcggggctggggccgaaccaggacccccttctcagcgggtgggttccgggcccttccctcagccaccacgcgacgccttgcactgcagccgcgtccccgcagaccgggtgtgggcggccctggggtcgccggggcggcctcggacaggacttcggaagctttggcggatcggatgaaatccgtgtgcccttgccgtgcgcgaggctgttttccgccccttccagcccggggcaggagcgtcctcggcggcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaa

SEQ ID NO: 132047 - DNA, 936 bp, Homo sapiens
  Payload ID: 5777
  Gene Symbol: FAM136A
  Gene Name: family with sequence similarity 136, member A
  ENST ID: ENST00000450256
  CDS Start-End: 46-363
atatgggcgccggcgcggagcgccgcggggcagcgcggggtcgccatggctgagctgcagcagctccgggtgcaggaggcggtggagtccatggtgaagagtctggaaagagagaacatccggaagatgcaggtgagcggcccgaggcccagcagaggcgctgccaacgtgaaagaccagaaaggcgaggacttccggcctccccgttggccaggtcatgcctgcttctcttgcgcccaacctcgcttcacacagcgcgggtttctacactgttcttctctgagccccgcaatgcctctgtgtgtttcggtcctgcttctctcacggaggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggct

SEQ ID NO: 132048 - DNA, 885 bp, Homo sapiens
  Payload ID: 5777
  Gene Symbol: FAM136A
  Gene Name: family with sequence similarity 136, member A
  ENST ID: ENST00000430566
  CDS Start-End: 35-772
ggcgcggagcgccgcggggcagcgcggggtcgccatggctgagctgcagcagctccgggtgcaggaggcggtggagtccatggtgaagagtctggaaagagagaacatccggaagatgcaggtagcggggctggggccgaaccaggacccccttctcagcgggtgggttccgggcccttccctcagccaccacgcgacgccttgcactgcagccgcgtccccgcagaccgggtgtgggcggccctggggtcgccggggcggcctcggacaggacttcggaagctttggcggatcggatgaaatccgtgtgcccttgccgtgcgcgaggctgttttccgccccttccagcccggggcaggagcgtcctcggcggcaggtgggaagcccctggtggcaggcgctcgccccaccaccttcccctcttacgcggccccttccgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccac

SEQ ID NO: 132049 - DNA, 2708 bp, Homo sapiens
  Payload ID: 5778
  Gene Symbol: FAM149A
  Gene Name: family with sequence similarity 149, member A
  Uniprot ID: A5PLN7
  ENST ID: ENST00000227065
  CDS Start-End: 580-2028
gcggaggatctggagagggaaggggcgtgcgagccccgcggaccccgggcgcgcccgggccgcctgagctgggccagccgcgcggcgggcgcgggcgcgggcgcgggcgcgggcgcgggcgggtggggagccccagccccggggccgcgggggcgcgtgaccggctgtctgcgtggggcccgcgcgcggtgcctctgcctgacggtgcccgagcctagcgcggagcctggcgcgggggctgcgagcacaggcccggggctgatcgtaatcggaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagctatggc

SEQ ID NO: 132050 - DNA, 2997 bp, Homo sapiens
  Payload ID: 5778
  Gene Symbol: FAM149A
  Gene Name: family with sequence similarity 149, member A
  Uniprot ID: A5PLN7
  ENST ID: ENST00000356371
  CDS Start-End: 1-2322
atgaaggctgctgtgctggaccttgggtctctcttggccaaactcttcgagacctcgacggcgccccccgcaggcccctcctccagaccctcgggaggtgctgccgctgcagggtcggggggctccagggcgggcaccccgttgggtaccgccccgaccctcctccgcgccctggctccggactccccctccgcctcgcggcggtcgcccgccccgctgctctcctccccctactcccggggctccgccgccagccgcgccgcgggagcagtggggaccctgctctcttggcccagtagccctagagcgggtaaagccccgccccagccccccactccctccggcgggggctgctcccctgctcgcctggtggtcccagcgcggccgccctcgggccccggcggggtctgggccgcgctccccaggaacccgctccagcctggccccggagagcgagagctcggcgcctgcgtggcccccggggctggccccagaaccctgttccttacgctgcctgacatcggcgaggagggggcctcggacggcgactccggggatggcgaagcaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagct

SEQ ID NO: 132051 - DNA, 1815 bp, Homo sapiens
  Payload ID: 5778
  Gene Symbol: FAM149A
  Gene Name: family with sequence similarity 149, member A
  ENST ID: ENST00000389354
  CDS Start-End: 216-1424
cgcattttacaagaaatgtgcagaaagccattgataaatatacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttg

SEQ ID NO: 132052 - DNA, 557 bp, Homo sapiens
  Payload ID: 5778
  Gene Symbol: FAM149A
  Gene Name: family with sequence similarity 149, member A
  ENST ID: ENST00000509574
  CDS Start-End: 449-557
gaattaaaatccgatttggaagagagaagggcagccagcaccagtatgcacagcccccggccccagagacccgggaaggagtagggaggccgggccgtgcgcggaggagtggccgctgggttggaaacccggcccggcagggagcggggaaggcgcgctttcccggagaagaggactgtcagaaggacgtagaaggcacggttttactgtgaggagcaaagattctttacctacgcattttacaagaaatgtgcagaaagccattgataaatatacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcc

SEQ ID NO: 132053 - DNA, 570 bp, Homo sapiens
  Payload ID: 5778
  Gene Symbol: FAM149A
  Gene Name: family with sequence similarity 149, member A
  ENST ID: ENST00000510790
  CDS Start-End: 388-570
aaaactgaaacgagcacatggtaacgcaagcggcaggcatgctcggggtgtgcaggagatgcaccggcttgtgtgagccgaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagt

SEQ ID NO: 132054 - DNA, 716 bp, Homo sapiens
  Payload ID: 5778
  Gene Symbol: FAM149A
  Gene Name: family with sequence similarity 149, member A
  ENST ID: ENST00000504330
  CDS Start-End: 488-716
tactaaaatccctgtcgtgggaaaggcatgcctcgtgcagtgcccaccctctgagactcaaaaatgtagttcacctccgcgacctcaccccttcttcccttagcatgtgaaaatgacggcttggcagtttcaccagctcacaggagagcgtccagctgctctgctcctggtataatcctgggcctccaaaactgaaacgagcacatgaagaggactgtcagaaggacgtagaaggcacggttttactgtgaggagcaaagattctttacctacgcattttacaagaaatgtgcagaaagccattgataaatatacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggct

SEQ ID NO: 132055 - DNA, 775 bp, Homo sapiens
  Payload ID: 5778
  Gene Symbol: FAM149A
  Gene Name: family with sequence similarity 149, member A
  ENST ID: ENST00000502894
  CDS Start-End: 1-161
cattgacacaaatggaatttgctgctcacacatggacaggtcaaagtattttgacagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaag

SEQ ID NO: 132056 - DNA, 633 bp, Homo sapiens
  Payload ID: 5778
  Gene Symbol: FAM149A
  Gene Name: family with sequence similarity 149, member A
  ENST ID: ENST00000512271
  CDS Start-End: 1-478
ttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaa

SEQ ID NO: 132057 - DNA, 695 bp, Homo sapiens
  Payload ID: 5778
  Gene Symbol: FAM149A
  Gene Name: family with sequence similarity 149, member A
  ENST ID: ENST00000510843
  CDS Start-End: 1-443
cttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggagggaatagcaaatgtttggggcctgtggcctgacctcagaaacctcgatcacagagcacacctgcagagacttacttacctgctgtgaggtcaagaagaggggaatgtccaaaagctctcaatgaactgggggcctcactcaaaaaaaaaaaaaaaaaaaaatgctgtcttaggagcagtgagtacctctgtctgctatagcgttttcatgctctatttctaagtgaaactctactctcagattctctttgaaaatctgatgataaaaatgcttgagaaaattaa

SEQ ID NO: 132058 - DNA, 2070 bp, Homo sapiens
  Payload ID: 5778
  Gene Symbol: FAM149A
  Gene Name: family with sequence similarity 149, member A
  Uniprot ID: A5PLN7
  ENST ID: ENST00000514153
  CDS Start-End: 467-1915
gggcgcgggcgcgggcgcgggcgcgggcgcgggcgggtggggagccccagccccggggccgcgggggcgcgtgaccggctgtctgcgtggggcccgcgcgcggtgcctctgcctgacggtgcccgagcctagcgcggagcctggcgcgggggctgcgagcacaggcccggggctgatcgtaatcggaagaggactgtcagaaggacgtagaaggcacggttttactgtgaggagcaaagattctttacctacgcattttacaagaaatgtgcagaaagccattgataaatatacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaa

SEQ ID NO: 132059 - DNA, 2011 bp, Homo sapiens
  Payload ID: 5778
  Gene Symbol: FAM149A
  Gene Name: family with sequence similarity 149, member A
  Uniprot ID: A5PLN7
  ENST ID: ENST00000503432
  CDS Start-End: 410-1858
gctgctgtttcaagctcgttcgcccaaatacatctttctacccaccttccctatcgtcagagaggtggcctgaccccagcacgtgcaagcttgtcaggctggaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttg

SEQ ID NO: 132060 - DNA, 1990 bp, Homo sapiens
  Payload ID: 5778
  Gene Symbol: FAM149A
  Gene Name: family with sequence similarity 149, member A
  Uniprot ID: A5PLN7
  ENST ID: ENST00000502970
  CDS Start-End: 419-1867
gggcgtgcgagccccgcggaccccgggcgcgcccgggccgcctgagctgggccagccgcgcggcgggcgcgggcgcgggcgcgggcgcgggcgcgggcgggtggggagccccagccccggggccgcgggggcgcgtgaccggctgtctgcgtggggcccgcgcgcggtgcctctgcctgacggtgcccgagcctagcgcggagcctggcgcgggggctgcgagcacaggcccggggctgatcgtaatcggaagaggactgtcagaaggacgtagaaggcacggttttactgtgaggagcaaagattctttacctacgcattttacaagaaatgtgcagaaagccattgataaatatacctggaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagag

SEQ ID NO: 132061 - DNA, 5408 bp, Homo sapiens
  Payload ID: 5779
  Gene Symbol: FAM149B1
  Gene Name: family with sequence similarity 149, member B1
  Uniprot ID: Q96BN6
  ENST ID: ENST00000242505
  CDS Start-End: 175-1923
ggggaccctggggaggtggctgctcggagtctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggtgaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctgaaacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagag

SEQ ID NO: 132062 - DNA, 1534 bp, Homo sapiens
  Payload ID: 5779
  Gene Symbol: FAM149B1
  Gene Name: family with sequence similarity 149, member B1
  ENST ID: ENST00000372955
  CDS Start-End: 1-1409
cttttacatcagccgacactgggaattcactgtctgcttttccaagttatacaggcgcagggatatctactgaaggaagctcggacttctcctggggatatggtgaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaagatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaa

SEQ ID NO: 132063 - DNA, 2169 bp, Homo sapiens
  Payload ID: 5779
  Gene Symbol: FAM149B1
  Gene Name: family with sequence similarity 149, member B1
  ENST ID: ENST00000445951
  CDS Start-End: 1-1008
tccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacct

SEQ ID NO: 132064 - DNA, 1044 bp, Homo sapiens
  Payload ID: 5779
  Gene Symbol: FAM149B1
  Gene Name: family with sequence similarity 149, member B1
  ENST ID: ENST00000475829
  CDS Start-End: 1-630
gggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtgtaggtttcaaaagcagaacttctggaaaccgtgcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaa

SEQ ID NO: 132065 - DNA, 1217 bp, Homo sapiens
  Payload ID: 5780
  Gene Symbol: FAM150A
  Gene Name: family with sequence similarity 150, member A
  Uniprot ID: Q6UXT8
  ENST ID: ENST00000358543
  CDS Start-End: 252-641
tggccccaggcaccgcctcccgttcccgccccgcgccccgcagcgcttaggcttcggcacactgaggaccgagtcccagtgcagctccagccgacccccgggacgtagacaagggcaggcgcgcggtgaagactgcggccggccgcgtagccgcgctgtggtcccgctggccttctcttgggccgcgcaccctccggacctgcgtcgggatcctcccggagtctcccgctctctcctcccggcttgcgaacatgcggccccttaagcccggcgcccctttgcccgcactcttcctgctggcgctggctttgtccccgcacggagcccacgggaggccccgggggcgcaggggagcgcgcgtcacggataaggagcccaagccgttgcttttcctccccgcggccggggccggccggactcccagcggctcccggagcgcagaaatattcccaagagactctaacttaaaagacaaattcataaagcatttcacagggccggtcacattttcaccagaatgcagcaaacatttccaccgactctattacaataccagggagtgctcaacgccagcttattacaaaagatgtgctagattgttaacaagattagcagtgagtccactgtgctcccagacctagcaaaactaccctacatttcctaagaatgtacatctaatttgaagaaaaagtgcctcaaatcatgcaaaatgtaaaaaaagatgaaatttatatttttatggatattaagatgagtaaaataagagacttcccagaaataactggttagctgtttcctgtcatagaatggagtctttcttgctttatctttttgtgtatacagtaatttataattttgtaaaacagagtttgaatcgcatattgaaaattagatattaaaaattgtgtgattgtattttatttttactagatatattattttctttatatggttaacattctaattaaacatttaattgtgtaaattatatctgtgagtgccagtgagaaataatgatttttttgtatatgactgttagtatatatttgtcaaatcatcgtgtaccaagttaaattttataattcttatttaatatttaaatacatttatttagaacttgttgtcttcacttgcattaatttgaactgtgaattttattaaagttgaaatatgaaaaaatgtgttgtttcctttgaattaaagatgtttgtaataga

SEQ ID NO: 132066 - DNA, 536 bp, Homo sapiens
  Payload ID: 5780
  Gene Symbol: FAM150A
  Gene Name: family with sequence similarity 150, member A
  Uniprot ID: Q6UXT8
  ENST ID: ENST00000523939
  CDS Start-End: 153-488
gggacgtagacaagggcaggcgcgcggtgaagactgcggccggccgcgtagccgcgctgtggtcccgctggccttctcttgggccgcgcaccctccggacctgcgtcgggatcctcccggagtctcccgctctctcctcccggcttgcgaacatgcggccccttaagcccggcgcccctttgcccgcactcttcctgctggcgctggctttgtccccgcacggagcccacgggaggccccgggggcgcaggggagcgcgcgtcacggataaggagcccaagccgttgcttttcctccccgcggccggggccggccggactcccagcggctcccggagcgcagaaatattcccaagagactctaacttaaaagacaaattcataaagcatttcacagggccggtcacattttcaccagaatgcagcaaacatttccaccgactctattacaataccagggagtgctcaacgccagcttacatttcctaagaatgtacatctaatttgaagaaaaagtgcctcaaatcatgcaaaatg

SEQ ID NO: 132067 - DNA, 449 bp, Homo sapiens
  Payload ID: 5781
  Gene Symbol: FAM150B
  Gene Name: family with sequence similarity 150, member B
  ENST ID: ENST00000344414
  CDS Start-End: 74-253
gaagtttgcttggcagagtctttccctgggattcttaccctacaaaccagaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttga

SEQ ID NO: 132068 - DNA, 1389 bp, Homo sapiens
  Payload ID: 5781
  Gene Symbol: FAM150B
  Gene Name: family with sequence similarity 150, member B
  Uniprot ID: Q6UX46
  ENST ID: ENST00000403610
  CDS Start-End: 342-800
cgcgggagcgcggcccctccgaggtccgcccgcggccggggagctgcctggcacccgcggcttccaaaggggaaagaaagttgcgcccgcgccaggcgcagcgcgctcggcggacgcggcctttcgggcgaaagttaggaggggccgggctggcgggcgggcgggttccgggggctcctttccgcaccagcggcggtcgctccccgtgggcgggacctcgggcgtgatcgtcgaggagaccgcggctccctcacctgccggcttgttcctcggggtccgcggagcgagcccagctctcggcgcgtgtcggagtctcccagccccgcggccccgagcgcacgatgcgcggacccgggcaccccctcctcctggggctgctgctggtgctgggggcggcggggcgcggccgggggggcgcggagccccgggagccggcggacggacaggcgctgctgcggctggtggtggaactcgtccaggagctgcggaagcaccactcggcggagcacaagggcctgcagctcctcgggcgggactgcgccctgggccgcgcggaggcggcggggctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagcagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgttataatga

SEQ ID NO: 132069 - DNA, 526 bp, Homo sapiens
  Payload ID: 5781
  Gene Symbol: FAM150B
  Gene Name: family with sequence similarity 150, member B
  ENST ID: ENST00000401489
  CDS Start-End: 1-308
agcaccactcggcggagcacaagggcctgcagctcctcgggcgggactgcgccctgggccgcgcggaggcggcggggctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttattt

SEQ ID NO: 132070 - DNA, 748 bp, Homo sapiens
  Payload ID: 5781
  Gene Symbol: FAM150B
  Gene Name: family with sequence similarity 150, member B
  ENST ID: ENST00000401503
  CDS Start-End: 185-367
ctttggaaatggaagcatttccagcaaagctttcccaactgaaaaggaagcatccaggctccttcatggccctgcccagagtggtggcccacggggaatttcccaggaaagcatgaaagcgtctaatgcttttgtgacacaatcaggtcaaacatgataagaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagcagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtat

SEQ ID NO: 132071 - DNA, 558 bp, Homo sapiens
  Payload ID: 5781
  Gene Symbol: FAM150B
  Gene Name: family with sequence similarity 150, member B
  ENST ID: ENST00000405290
  CDS Start-End: 161-340
caaagctttcccaactgaaaaggaagcatccaggctccttcatggccctgcccagagtggtggcccacggggaatttcccaggaaagcatgaaagcgtctaatgcttttgtgacacaatcaggtcaaacatgataagaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttattt

SEQ ID NO: 132072 - DNA, 809 bp, Homo sapiens
  Payload ID: 5781
  Gene Symbol: FAM150B
  Gene Name: family with sequence similarity 150, member B
  ENST ID: ENST00000452023
  CDS Start-End: 357-809
ggcggggggactgacgaagatccgcatgggggtactaacacttcagcggcttctaattaaagccccgctcggagcccttggggacccgcctgacgtcggcgggcgcggggataagaagctccccgaggtctgaggcgggactcggagccggcgcaccccaggtcggccgtgggtccagcgctcggagcggccgagtccccgcgtcccgtgcgctccgcccgccgggcatggagtagtggcgcagctcggggcgcggggacagacgtgcgcacagacggcgacgactccggcggctccagcgagcccagctctcggcgcgtgtcggagtctcccagccccgcggccccgagcgcacgatgcgcggacccgggcaccccctcctcctggggctgctgctggtgctgggggcggcggggcgcggccgggggggcgcggagccccgggagccggcggacggacaggcgctgctgcggctggtggtggaactcgtccaggagctgcggaagcaccactcggcggagcacaagggcctgcagctcctcgggcgggactgcgccctgggccgcgcggaggcggcggggctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataag

SEQ ID NO: 132073 - DNA, 496 bp, Homo sapiens
  Payload ID: 5781
  Gene Symbol: FAM150B
  Gene Name: family with sequence similarity 150, member B
  Uniprot ID: Q6UX46
  ENST ID: ENST00000619265
  CDS Start-End: 3-278
cgatgcgcggacccgggcaccccctcctcctggggctgctgctggtgctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttattt

SEQ ID NO: 132074 - DNA, 2005 bp, Homo sapiens
  Payload ID: 5782
  Gene Symbol: FAM151A
  Gene Name: family with sequence similarity 151, member A
  Uniprot ID: Q8WW52
  ENST ID: ENST00000302250
  CDS Start-End: 162-1919
gttatctccagaggggatattacagggctgcagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgtcacagttcaagcagctggccttgaatgccacacggaaaccaatgtactacacgggaggcagcctgatccctcttctccagctgcctggggatgacggtctgaatgtggagtggctggttcctgacgtccagggcagcggtaaaacagcaacaatgaccctcccagacacagaaggcatgatcctgctgaacactggcctcgagggaactgtggctgaaaaccccgtgcccattgttcatactccaagtggcaacatcctgacgctggagtcctgcctgcagcagctggccacacatcccggacactggggcatccatttgcaaatagcggagcccgcagccctccggccatccctggccttgctggcacgcctctccagccttggcctcttgcattggcctgtgtgggttggggccaaaatctcccacgggagtttttcggtccccggccatgtggctggcagagagctgcttacagctgtggctgaggtcttcccccacgtgactgtggcaccaggctggcctgaggaggtgctgggcagtggctacagggaacagctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggccagcggacctcagggcggaggcttcccacggggaggcaggaagaaataaaggtctttggctttctcc

SEQ ID NO: 132075 - DNA, 1444 bp, Homo sapiens
  Payload ID: 5782
  Gene Symbol: FAM151A
  Gene Name: family with sequence similarity 151, member A
  Uniprot ID: Q8WW52
  ENST ID: ENST00000371304
  CDS Start-End: 162-1358
gttatctccagaggggatattacagggctgcagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggccagcggacctcagggcggaggcttcccacggggaggcaggaagaaataaaggtctttggctttctcc

SEQ ID NO: 132076 - DNA, 1717 bp, Homo sapiens
  Payload ID: 5783
  Gene Symbol: FAM151B
  Gene Name: family with sequence similarity 151, member B
  Uniprot ID: Q6UXP7
  ENST ID: ENST00000282226
  CDS Start-End: 156-986
gtgccgcggctccgtttggttccgcttcgctggcgcccgccgggctcttcccccgccgaggcctgtggtttgtggagtcgaatttccctgccaccagtgcccggttagcaggggcgccagcctgggcgcctgcgcggacggcgggcgtcgtcaccatggcagcatccgctggaggcccaggatcttggagtgaaaatatactggaatattttctgagaaatagccagattacagcagaagacggtgctgagatcacctggtatcatgcagctaaccacaaggcacaaacaaatgaggcactgaaaagtactgctcacatgatagaggctgatgtccttcttccaagtgatggatcagaacacagccagccaattatggcccatccccctgaaacaaacagtgataatactctacaggagtggctgactgaagttatgaaaagcaataaaggcatcaagctggatttcaaaagtctggcagttgtagaaccatccatgatgctcttggaaaatgtgaagaggcatctgaagcgtcctgtatggattaatgccgatattcttcctggtccaaatggaaatagcaaagtaatagatgcaaaaccatttttagacaccgtgatatccttctttccagacgtgacgttttccctgggttggacaacaggatggcatcctgagaaagtcaatgaagggtacagttggacaatggtgaaagagatggaatatatatgtaatgaactaagtcagcctgtaacgttccctgtcagagcagcattagtcaggcagtcttgttctcagttactttggctgttaaagaaatcaaacaggtacagcctgactatttggactggaaaaaatgataactattccgttgaagatttactttacattagagaccattttgacaaaaaacaagttttctatgacatcttggaaccacaaaaccatgaatttaaacaagccattggaatcaaagttaatctctaagaagaagattctcaattatttcctgtgttttggtttcataatccttctctccattggtctgaattaattaccatataaattatggttattgattgacgttccaagtcatctaatcaagaaacgtttattgtatgcttactctgtgggcatatgtccttataatagtgcacttacataaaagatttggaaagaagagatttatttacacacgtggcctagtctaataataattcaggaaaatgatactctgcaccccttcataaaaatagttttgataaactaaagatgattggcagaatccatatgtcataaaacaggtataaatcacatgtgcttggcacttgcattacagagattatgaaaaatatggtactcttttcctttttcctagaaaactggttattttagagataacaaaaaaggaagagggcttttaaaatgtttttaattttcacaggggtcagcagctgtctcatatcaagatctattaatccatttcctgaaactgtagattaaattagatagatctagaatttccatgtgattgagaagcatgctagtggctaagtgttttttttatatttcttatttctatagtatctgatttatagtggacaatatactgttggagagcagttttagtctttgttatgtatcatttgttttccaagtttcttactgccaccaccttcattcaggtccttgttctactagtaaaactttatgaacta

SEQ ID NO: 132077 - DNA, 508 bp, Homo sapiens
  Payload ID: 5783
  Gene Symbol: FAM151B
  Gene Name: family with sequence similarity 151, member B
  ENST ID: ENST00000502608
  CDS Start-End: 156-359
gtgccgcggctccgtttggttccgcttcgctggcgcccgccgggctcttcccccgccgaggcctgtggtttgtggagtcgaatttccctgccaccagtgcccggttagcaggggcgccagcctgggcgcctgcgcggacggcgggcgtcgtcaccatggcagcatccgctggaggcccaggatcttggagtgaaaatatactggaatattttctgagaaatagccagattacagcagaagacggtgctgagatcacctggtatcatgcagctaaccacaaggcacaaacaaatgaggcactgaaaaagacgagatttcaccgtgttggccagactggtctcgaactcctgacctcatgatccgcctgccttggcctcgcgaagtgctgggattacaggtgtgagccaccacgcccggccaagaactttacttttattaagatgagtggattggtcacgtgagatggcagtgacaaaaacttcagtttaaaatgccttatggatctgta

SEQ ID NO: 132078 - DNA, 4499 bp, Homo sapiens
  Payload ID: 5784
  Gene Symbol: FAM153A
  Gene Name: family with sequence similarity 153, member A
  Uniprot ID: Q9UHL3
  ENST ID: ENST00000360669
  CDS Start-End: 74-1006
taaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacacgatggagggggacccagacacactggccgaatttctgatcagggatgtacttcaggagctgtccagttacaacggtgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggatgatattgatgatgaaatgtcttacgatgatcatttagaggtttatttcgaacaactggcaattccaggaatgatggaataaagcatacgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatggacatctacatattcttcattcagatcaaccagtggctagcatttgccaccttttgcagtttctttctctttccataagtactttcttctctgaatcatttgaaagcaaatgaaaacagtagcctaaagtgtcagtttcaacccgaaaataacagctctgatttctcatggctcacactcgtctgaaatgactcgggtagaggctgaggaaggctgtgttgtttgtctacctgggactacacctactgaaagaagttctcaagttctgattgagttctaaaattcttttgaagattggaattcttcatatggcaccatgggccggcactgccacgttttccaaggaacctgccagagctcctgcggaagctgctcctcgggcgatggagtccctttgctgctaggcccttcttcagtcaccacaggatgcctgccattcatgaacaggaaggagaggacgggctttgaataaaaaacaggatccaggaaatatttgtgaggccatttggacttcagtgtgaaatggtgttaaaagatgaagtcatttattcaagaagtaaacctctgccacctggactgtgctcagacatttcattgattttgtttaataaacattttctggctttgggaggtgtctctcttggtagagcacagtgtcaaagatggacaagatggacacatagtccattatttggtattgtttgtgtatgggagcggaccacaaattaatgtttggagaacaattttgtcataacacactgttgaggctcagttgtacagaactggaaaagtctttcagcttggcacatgtcctgattcagcctttgtttaacatacattccaatccggattctatcttcactggctacaaagaccacctgatacgtgcaccacgacacaggagctgctggagagggggtagtgttatcacctcaaacccacagccatatttttcaaaagccagcttagagagaggtgtactgatagctgcatagagaacatgcagtccatccattcttcccagtgatgtacatttctcaatcagtaaccacgtggtataccagccttgagtgtcacatctcccaaccataccaaatggatcacctaactggaggtggggggggcccctcagaaatgagatttcgtatttactgtaaaattgccttattttttcttttgaggtggagtctcactctgttgcctgggctggagtgcaatggtgtgatcactgctcactgcaacctccgcctcctgggttcaagcagttctcctgcctcagcctcccaagtagctgcaattacaggcgcatgccaccactcccagcaaatttttatatttttagtggagacagggtttcaccatgttggccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgtttttttaattgttaagaattttctgtctagtttagatataagccctttatcagacatgtgttttgcaaatattttctcctagtctgtggcttgtattctgtctcttaacagtcattttatttttacttttgaaactaaagaagaagaatggtcagctttccgttattcttgtaacagtaatggcagaaccaagtctgctaatgctacattgagcaaagaaagtcacctggtcaagtccaacattaatgaaatggggtagtacatgcaggcggcgttggggttggggagggaacaaatgcttcttgagagtaatataatctgccataccatccaggaacctacaatggctatctattaccttattctctggtttgtttaatgttcaaatctttcctaaagatccttcaacttttctggaagaatctaatctgataacaccatcaaaaacacattacttcttttggcataatttaaattgtaagacatcattcacatttatcaatgttacatatataagaactcacccaccatattcctccttgaggaattacagcatgtaattctataaccatttttataatcgtctaacaattttataatggattggctgctatcaattttttaaaagtcatggcttctccagtcatttcttgcttatcaaaattatttcatgagatgggtctatccttgtatatttgaaaatgaggtttgcttccttctacttaaaaaacaacttgaacatacctgtttggatcacatggtcttgtcctgataacttggaagaggttgcttcagcattattcttattgttgtggtggttattattaacattgtttcatattccgtttaaaaaattaaaattttacacaagaccaatgtcttcttttcaattccagtacagtcttcagaagtaactaatgctattggctttgtgcattataatttcagaccattgtatatgtctttagttatatgtacagtatacacacatatgtgtcatattattccattttttctagcattaaacattgctat

SEQ ID NO: 132079 - DNA, 1138 bp, Homo sapiens
  Payload ID: 5784
  Gene Symbol: FAM153A
  Gene Name: family with sequence similarity 153, member A
  ENST ID: ENST00000393518
  CDS Start-End: 454-798
aatgcgtatgcccgttacccttcaattccattatactaaaatacccttgggaaatagagatacatgcactttgtttttcacagcacttattttaaaaagaacccatagaatggatcttataagtaaatttcagttgcatccataggatgcaataatatgtgaccatcaaaggtgacaatagatatagaagtacgttgatgtgcgaagatgtattttgttttagccagcgaggaaaaaagaatcagtttgattacacatttaccaaacattaagaatttaatatggtaacttttatttcagtattaaaatagcaattttatttattacttttttatatacagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgtgagtgtgcagtgggcagaatgatgagggaagtgggcacgtgcccatgttcttcttggctacgctcactttcttgttgtcccatcaggaaaaccagaaagcccaagaagaaaaccaggaagcccagcaagaaaagccggtggaatgtcctgaaatgttgggacatttttaatatattttagagacctctgaaggcaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagg

SEQ ID NO: 132080 - DNA, 1966 bp, Homo sapiens
  Payload ID: 5784
  Gene Symbol: FAM153A
  Gene Name: family with sequence similarity 153, member A
  Uniprot ID: Q9UHL3
  ENST ID: ENST00000440605
  CDS Start-End: 285-1217
aggtgacaatagatatagaagtacgttgatgtgcgaagatgtattttgttttagccagcgaggaaaaaagaatcagtttgattacacatttaccaaacattaagaatttaatatggtaacttttatttcagtattaaaatagcaattttatttattacttttttatatacagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacacgatggagggggacccagacacactggccgaatttctgatcagggatgtacttcaggagctgtccagttacaacggtgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggcaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagcctctggggggtctgggggcctccagttccaggggtccttcagcctctgtgggggcctggggtggcctcatggccccctttttcaagatgaggttggaggcttctgtatgtagagggcactggcttgggccaaatgccaacaaaacaaacccttgaagacatttcagggccatgctcacttgggagggtttgaggacatgatttagcgagcctctgttttttaaatatattttccaatcttgaaataaggta

SEQ ID NO: 132081 - DNA, 596 bp, Homo sapiens
  Payload ID: 5784
  Gene Symbol: FAM153A
  Gene Name: family with sequence similarity 153, member A
  ENST ID: ENST00000505531
  CDS Start-End: 208-596
aggctcactaggtctgagaggtcggaggccgccagtgtcgctgctgaagggtggaccaggcgggatcgcggattctgggctagatcgcagacttgaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtggtgacctggaagacctggaggagcatgtgccagggcagacagtctctgaggaagccacaggggttcacatgatgcaggtggacccagccacgctggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaag

SEQ ID NO: 132082 - DNA, 1641 bp, Homo sapiens
  Payload ID: 5784
  Gene Symbol: FAM153A
  Gene Name: family with sequence similarity 153, member A
  Uniprot ID: Q9UHL3
  ENST ID: ENST00000510276
  CDS Start-End: 422-1354
agcaaagtcaggcggtcggcttcgccagcagccgatgagtctcatcctgtggattgcccagcgccagggatcaggatccggagaggtgtccaggaggagcagaccctcagaccagaattcgacaccaaattttggaacttaaaaagaagattcttaaaacttacaatccagcccagggcttcccagctgtcttcatccaggcctgcgccggtgttcacagtggtcctcatctaagccagccaagaagatctctgtcatccacgtgacagccagcccagatgtccctagccgtcctcatcaaggccagccagtttgcttacacgtgtgctaattggagccagccaccctcatagaggccatcccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacacgatggagggggacccagacacactggccgaatttctgatcagggatgtacttcaggagctgtccagttacaacggtgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaatt

SEQ ID NO: 132083 - DNA, 448 bp, Homo sapiens
  Payload ID: 5784
  Gene Symbol: FAM153A
  Gene Name: family with sequence similarity 153, member A
  ENST ID: ENST00000504518
  CDS Start-End: 91-448
atgatataggtcttgcctttcattttaactgccattctggcaactgaacgttggcagtaaacgcagcttagttgtctcagaggactcacaatgggatgtgtttatagttgttgccttgaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctg

SEQ ID NO: 132084 - DNA, 563 bp, Homo sapiens
  Payload ID: 5784
  Gene Symbol: FAM153A
  Gene Name: family with sequence similarity 153, member A
  ENST ID: ENST00000503845
  CDS Start-End: 92-217
gatgatataggtcttgcctttcattttaactgccattctggcaactgaacgttggcagtaaacgcagcttagttgtctcagaggactcacaatgggatgtgtttatagttgttgccttgaagtgtgttgtggcgaggatgaaatagtgtatcctaggatgccaggggaatccaccgtctgccaccgcgagcgtgagaagccaatcacctatcactgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctc

SEQ ID NO: 132085 - DNA, 558 bp, Homo sapiens
  Payload ID: 5784
  Gene Symbol: FAM153A
  Gene Name: family with sequence similarity 153, member A
  ENST ID: ENST00000503567
  CDS Start-End: 486-558
aaggcggggtgggccgcgcgcctgcgattttccgtccgtggtcctggggcagccctggccagcccaggagaacccgcgagcccagcggcgcctgcacctgcggcttccgggagccgggcggctttgcgaggctcactaggtctgagagaattcgacaccaaattttggaacttaaaaagaagattcttaaaacttacaatccagattctgggagttctgatgaatatgcagtcagcccagggcttcccagctgtcttcatccaggcctgcgccggtgttcacagtggtcctcatctaagccagccaagaagatctctgtcatccacgtgacagccagcccagatgtccctagccgtcctcatcaaggccagccagtttgcttacacgtgtgctaattggagccagccaccctcatagaggccatcccagattacgatgaggacctggtgcaggaagcttcatctgaagatgtcctgggcgttcatatggtggacaaagacacagagagagacagtacgtattctggaatcacccctatgctgaggaaaaattctagtg

SEQ ID NO: 132086 - DNA, 576 bp, Homo sapiens
  Payload ID: 5784
  Gene Symbol: FAM153A
  Gene Name: family with sequence similarity 153, member A
  ENST ID: ENST00000515787
  CDS Start-End: 70-177
attttaactgccattctggcaactgaacgttggcagtaaacgcagcttagttgtctcagaggactcacaatgggatgtgtttatagttgttgccttgaagattacgatgaggacctggtgcaggaagcttcatctgaagatgtcctgggcgttcatatgtgttttgtttttctctaaatgcaggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagtt

SEQ ID NO: 132087 - DNA, 1437 bp, Homo sapiens
  Payload ID: 5784
  Gene Symbol: FAM153A
  Gene Name: family with sequence similarity 153, member A
  ENST ID: ENST00000513554
  CDS Start-End: 467-901
ttttgttttagccagcgaggaaaaaagaatcagtttgattacacatttaccaaacattaagaatttaatatggtaacttttatttcagtattaaaatagcaattttatttattacttttttatatacagaattcgacaccaaattttggaacttaaaaagaagattcttaaaacttacaatccagattctgggagttctgatgaatatgcagtcagcccagggcttcccagctgtcttcatccaggcctgcgccggtgttcacagtggtcctcatctaagccagccaagaagatctctgtcatccacgtgacagccagcccagatgtccctagccgtcctcatcaaggccagccagtttgcttacacgtgtgctaattggagccagccaccctcatagaggccatcccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgctggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggcaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagcctctggggggtctgggggcctccagttccaggggtcct

SEQ ID NO: 132088 - DNA, 1912 bp, Homo sapiens
  Payload ID: 5784
  Gene Symbol: FAM153A
  Gene Name: family with sequence similarity 153, member A
  ENST ID: ENST00000614127
  CDS Start-End: 1-1164
atgggatgtgtttatagttgttgccttgaagtgtgttgtggcgaggatgaaatagtgtatcctaggatgccaggggaatccaccgtctgccaccgcgagcgtgagaagccaatcacctatcactggtatcactggcatcccggccatatataccctagaattgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacacgatggagggggacccagacacactggccgaatttctgatcagggatgtacttcaggagctgtccagttacaacggtgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggcaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagcctctggggggtctgggggcctccagttccaggggtccttcagcctctgtgggggcctggggtggcctcatggccccctttttcaagatgaggttggaggcttctgtatgtagagggcactggcttgggccaaatgccaacaaaacaaacccttgaagacatttcagggccatgctcacttgggagggtttgaggacatgatttagcgagcctctgttttttaaatatattttccaatcttgaaataaggt

SEQ ID NO: 132089 - DNA, 1913 bp, Homo sapiens
  Payload ID: 5785
  Gene Symbol: FAM153B
  Gene Name: family with sequence similarity 153, member B
  Uniprot ID: P0C7A2
  ENST ID: ENST00000253490
  CDS Start-End: 1-1164
atgggatgtgcttatagttgttgcctcgaagtgtgttgtggcgaggatgaaatagtgtatcctaggatgccaggggaatccaccgtctgccaccgcgagcgtgagaagccaatcacctatcactggtatcactggcatcccggccatatataccctagagttgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggtaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagcctctggggggtctgggggcctccagttccaggggtccttcagcctctgtgggggcctggggtggcctcatggccccatttttcaagatgaggttggaggcttctgtatgtagagggcactggcttgggccaaatgccaacaaaacaaacccttgaagacatttcagggccatgctcacttgggagggtttgaggacatgatttagcgagcctctgttttttaaatatattttccaatcttgaaataaggta

SEQ ID NO: 132090 - DNA, 4334 bp, Homo sapiens
  Payload ID: 5785
  Gene Symbol: FAM153B
  Gene Name: family with sequence similarity 153, member B
  ENST ID: ENST00000508296
  CDS Start-End: 74-1006
taaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttaaagaccagcctggccaacaaggtgaaaccccgtctctactaaaaatacaaaaattagctaggcgtggtggcgcactcttgtagtcccagctatttgggaggctgaggcaggagaatcacttgacctcaggaggcggaggttgcagtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttttgtgctttcattttcttaatgacttttacctcatttttaaaacaaatccatagtatggatgatattgatgatgaaatgtcttacgatgatcatttagaggtttattttgaacaactggcaattccaggaatgatggaataaagcatacgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatagacatctgcatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcatactcgtctgaaacgactcaggtagaggctgaggaaggccgtgttgtttgtctacctgggactacacctactgaaagaagttctcaagttctgattgagttctaaaattttttgaagattggaattcttcatatggcaccatgggcccggcactgccacgttttccaaggaacctgccggagctcctgcggaagctgctcctcaggcgatggagtcccttcgctggtaggcccttcttcagtcaccacaggatgcctgccattcatgaacaagaaggagaggacgggctttgaataaaaaacaggatccaggaaatatttgtgaggccatttggacttcagtgtgaaatggtgttaaaagatgaagtcatttattcaagaagtaaacctctgccacctggactgtgcgcagacatttcattgattttgtttaataaacattttctggctttgggaggtgtctctcttggtagaacacagtgtcaaagatggacaagatggacacatagtccattatttggtattgtttgtgtatgggagcagaccacaaattaatgtttggagaacaattttgtcataacacactgttgaggctcagttgtacagaactggaaaagtcttcagcttggcacatgtcctgattcagcctttgtttaacatatattccaatccggattctatcttcactggctacaaagaccacctgatacgtgcaccacgacacaggagctgctggagagggggtagtgttatcacctcaaacccacagccatatttttcaaaagccagcttagagagaggtgtactgatagctgcatagagaacatgcagtccatccattcttcccagtgatgtacatttctcaatcagtaaccacgtggtataccagccttgagtgtcacatctcccaaccataccaaatggatcacctaactggaggtggggggggccctcagaaatgagatttcgtatttactgtaaaattgccttattttttcttttgaggtggagtctcactctgttgcctgggctggagtgcaatggtgtgatcactgctcactgcaacctccgcctcctgggttcaagcagttctcctgcctcagcctcccaagtagctgcaattacaggtgcatgccaccactcccagcaaatttttatatttttagtggagacagggtttcaccatgttgaccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgttttttaattgttaagaattttctgtctagtttagatataagccctttatcagacatgtgttttgcaaatattttctcctagtctgtggcttgtattctgtctcttaacactcattttatttttacttttggaactaaagaagaagaatggtcagctttccattattcttgtaacagtaatggcagaaccaagtctgctaatgctacactgagcaaagaaagtcacctggtgaagtccaacattaatgaaatggggtagtacatgcaggcagcgttgggggtggggagggaacaaatgcttcttgagagtaatataatctgccataccatccaggaacctacaatggctatctattaccttattctctggtttgtttaatgttcgaatctttccgaaagatccttcaacctttctggaagaatctaatctgataacaccatcaaaaacacattacttcttttggcataatttaaattgtaagacatcattcacatttatcaatgttacatatataagaactcacccaccatattcttccttgaggaattacagcatgtaattctataatcatttttataatcgtctaacaattttataatggattggttgcttactatcaattttttaaaagtcatggcttctccagtcatttcttgcttatcgaaattatttcatgagatgggtctctccttgtatatttgaaaatgaggtttgcttccttctacttaaaaaacaacttgaacatacctgtttggatcacatggtcttgtcctgataacttggaagaggttgcttcagcattgttcttattgttgtggtggttattattaatattgtttcatattctgtttaaaaaattaaaattttacacaaga

SEQ ID NO: 132091 - DNA, 1966 bp, Homo sapiens
  Payload ID: 5785
  Gene Symbol: FAM153B
  Gene Name: family with sequence similarity 153, member B
  ENST ID: ENST00000515817
  CDS Start-End: 285-1217
aggtgacaatagatatagaagtacgttgatgtgcgaagatgtattttgttttagccagcgaggaaaaaagaatcagtttgattatacatttaccaaacattaagaatttaatatggtaacttttatttcagtattaaaatagcaattttatttattacttttttatatacagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggtaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagcctctggggggtctgggggcctccagttccaggggtccttcagcctctgtgggggcctggggtggcctcatggccccatttttcaagatgaggttggaggcttctgtatgtagagggcactggcttgggccaaatgccaacaaaacaaacccttgaagacatttcagggccatgctcacttgggagggtttgaggacatgatttagcgagcctctgttttttaaatatattttccaatcttgaaataaggta

SEQ ID NO: 132092 - DNA, 602 bp, Homo sapiens
  Payload ID: 5785
  Gene Symbol: FAM153B
  Gene Name: family with sequence similarity 153, member B
  ENST ID: ENST00000503724
  CDS Start-End: 203-602
gttgctgaggtgatctgatgatataggtcttgcctttcattttaactgccattctggcaactgaacgttggcagtaaacgcagcttagttgtctcagaggactcacaatgggatgtgcttatagttgttgcctcgaagattacgatgaggacctggtgcaggaagcttcatctgaagatgtcctgggcgttcatatgttgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaac

SEQ ID NO: 132093 - DNA, 1641 bp, Homo sapiens
  Payload ID: 5785
  Gene Symbol: FAM153B
  Gene Name: family with sequence similarity 153, member B
  ENST ID: ENST00000510151
  CDS Start-End: 422-1354
agcaaagtcaggcggtcggcttcgccagcagccgatgagtctcatcctgtggattgcccagcgccagggatcaggatccggagaggtgtccaggaggagcagaccctcagaccagaattcgacaccaaattttggaacttaaaaagaagattcttaaaacttacaatccagcccagggcttcccagctgtcttcatccaggcctgcgccggtgttcacagtggtcctcatctaagccagccaagaagatctctgtcatccacgtgacagccagcccagatgtccctagccgtcctcatcaaggccagccagtttgcttacacgtgtgctaattggagccagccaccctcatagaggccatcccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttaaagaccagcctggccaacaaggtgaaaccccgtctctactaaaaatacaaaaatt

SEQ ID NO: 132094 - DNA, 1071 bp, Homo sapiens
  Payload ID: 5785
  Gene Symbol: FAM153B
  Gene Name: family with sequence similarity 153, member B
  ENST ID: ENST00000512862
  CDS Start-End: 202-636
actaggtctgagaggtcggaggccgccagtgtcgctgctgaagggtggaccaggcgggatcgcggattctgggctagatcgcagacttgaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttaaagaccagcctggccaacaaggtgaaaccccgtctctactaaaaatacaaaaattagctaggcgtggtggcgcactcttgtagtcccagctatttgggaggctgaggcaggagaatcacttgacctcaggaggcggaggttgcagtgagccgagatcatgccactgcaccccagcacctggctacagagtgagactttgtctc

SEQ ID NO: 132095 - DNA, 1050 bp, Homo sapiens
  Payload ID: 5785
  Gene Symbol: FAM153B
  Gene Name: family with sequence similarity 153, member B
  ENST ID: ENST00000611539
  CDS Start-End: 454-888
aatgcgtatgcccgttacccttcaattccattatactaaaatacccttgggaaatagagatacatgcactttgtttttcacagcacttattttaaaaagaacccatagaatggatcttataagtaaatttcagttgcatccataggatgcaataatatgtgaccatcaaaggtgacaatagatatagaagtacgttgatgtgcgaagatgtattttgttttagccagcgaggaaaaaagaatcagtttgattatacatttaccaaacattaagaatttaatatggtaacttttatttcagtattaaaatagcaattttatttattacttttttatatacagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggtaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagg

SEQ ID NO: 132096 - DNA, 1510 bp, Homo sapiens
  Payload ID: 5786
  Gene Symbol: FAM153C
  Gene Name: family with sequence similarity 153, member C
  Uniprot ID: Q494X1
  ENST ID: ENST00000398106
  CDS Start-End: 454-798
aatgcgtatgcccgttacccttcaattccattatactaaaatacccttgggaaatagagatacatgcactttgtttttcacagcacttattttaaaaagaacccatagaatggatcttataagtaaatttcagttgcatccataggatgcaataatatgtgaccatcaaaggtgacaatagatatagaagtacgttgatgtgcaaagatgtattttgttttagccagcgaggaaaaaagaatcagtttgattatacatttaccaaacattaagaatttaatatggtaacttttatttcagtattaaaatagcaattttatttattacttttttatatatagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgtgagtgtgcagtgcgcagaatgatgagggaagcaggcacgtgcccatgttcttcttggctacgctcactttcttgttgtcccatcaggaaaaccagaaagcccaagaagaaaaccaggaagcccagcaagaaaagccggtggaatgtcctgaaatgttgggacatttttaatatattttagagacctctgaaggtaagtgaaggatgccctgagaacatgctccaggaaacagacacccactccatagcagcccgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcctcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcgggccagcaggccctcagtaggtcctggtgtcaagcaggggacacggcaggatccaagaagcactgaaatgtgtccagtcccaggagtccttcagcctctggggggtctgggggcctccagttccaggggtcct

SEQ ID NO: 132097 - DNA, 597 bp, Homo sapiens
  Payload ID: 5786
  Gene Symbol: FAM153C
  Gene Name: family with sequence similarity 153, member C
  ENST ID: ENST00000511856
  CDS Start-End: 70-597
attttaactgccattctggcaactgaacgttggcagtaaacgcagcttagttgtctcagaggactcacaatgggatgtgcttatagttgttgcctcgaagtgtgttgtggcaaggatgaaatagtgtatcctaggatgccaggggaatccaccgtctgccaccgcgagcgtgagaagccaatcacctatcactggtatcactggcatcccggccatatataccctagagttgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgca

SEQ ID NO: 132098 - DNA, 539 bp, Homo sapiens
  Payload ID: 5786
  Gene Symbol: FAM153C
  Gene Name: family with sequence similarity 153, member C
  ENST ID: ENST00000504530
  CDS Start-End: 422-539
agcaaagtcaggcggtcggcttcgccagcagccgatgagtctcatcctgtggattgcccagcgccagggatcaggatccggagaggtgtccaggaggagcagaccctcagaccagaattcgacaccaaattttggaacttaaaaagaagattcttaaaacttacaatccagcccagggcttcccagctgtcttcatccaggcctgcgccggtgttcacagtggtcctcatctaagccagccaagaagatctctgtcatccacgtgacagccagcccagatgtccctagccgtcctcatcaaggccagccagtttgcttacacgtgtgctaattggagccagccaccctcatagaggccatcccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgg

SEQ ID NO: 132099 - DNA, 1071 bp, Homo sapiens
  Payload ID: 5786
  Gene Symbol: FAM153C
  Gene Name: family with sequence similarity 153, member C
  Uniprot ID: Q494X1
  ENST ID: ENST00000507848
  CDS Start-End: 202-636
actaggtctgagaggtcggaggccgccagtgtcgctgctgaagggcggaccaggcgggatcgcggattctgggctagatcgcagacttgaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctc

SEQ ID NO: 132100 - DNA, 926 bp, Homo sapiens
  Payload ID: 5786
  Gene Symbol: FAM153C
  Gene Name: family with sequence similarity 153, member C
  ENST ID: ENST00000511189
  CDS Start-End: 58-579
attctggcaactgaacgttggcagtaaacgcagcttagttgtctcagaggactcacaatgggatgtgcttatagttgttgcctcgaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaa

SEQ ID NO: 132101 - DNA, 1048 bp, Homo sapiens
  Payload ID: 5786
  Gene Symbol: FAM153C
  Gene Name: family with sequence similarity 153, member C
  Uniprot ID: Q494X1
  ENST ID: ENST00000620373
  CDS Start-End: 454-888
aatgcgtatgcccgttacccttcaattccattatactaaaatacccttgggaaatagagatacatgcactttgtttttcacagcacttattttaaaaagaacccatagaatggatcttataagtaaatttcagttgcatccataggatgcaataatatgtgaccatcaaaggtgacaatagatatagaagtacgttgatgtgcaaagatgtattttgttttagccagcgaggaaaaaagaatcagtttgattatacatttaccaaacattaagaatttaatatggtaacttttatttcagtattaaaatagcaattttatttattacttttttatatatagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggtaagtgaaggatgccctgagaacatgctccaggaaacagacacccactccatagcagcccgagcctgctgggctgagccctccacaggctgcttagtgagggagacactgaggtgctggtcgcacccccatgtgcaggactccaagg

SEQ ID NO: 132102 - DNA, 8503 bp, Homo sapiens
  Payload ID: 5787
  Gene Symbol: FAM155A
  Gene Name: family with sequence similarity 155, member A
  Uniprot ID: B1AL88
  ENST ID: ENST00000375915
  CDS Start-End: 140-1516
gagagaaagagagagaggagagagaagaaacgggaggaggggataaggaaattaaaccctttaagtcaatgcatattgtggtgacaccggcacaggcgccctcacggtggagtcggccagggctgtgcgttcccaaaatatgaccaggggtgcttggatgtgtcggcagtatgacgacggcttaaaaatctggttggcagcaccccgagagaacgagaaaccgttcatcgattccgagagggctcagaaatggcgactgtctctggcatctctcttgtttttcacagtcctgctctctgatcacttgtggttctgcgccgaggccaagctgacccgggcccgggacaaggagcaccagcagcagcagcggcagcagcagcagcagcagcagcagcagaggcagcggcagcagcagcagcagcagcggcggcagcaggagccctcctggcccgcgctcctggcgagcatgggggagtcctcgcccgccgcccaggcacacagactcctctccgcctcctcgtcccccaccctgcccccctccccgggagacggcggcggcggcggcggcaagggcaaccgaggcaaagacgaccggggcaaggctctttttctaggaaactctgccaagcccgtgtggcgcctggagacttgttacccccagggcgcgtcctcgggccagtgcttcacggtggagaatgcggacgcggtgtgcgccaggaactggagtcggggggcggccgggggggacgggcaggaggtgaggagcaagcatcccactccgctctggaacttgtcggatttttacctttcgttttgtaattcctacacactttgggagttgttctcggggttgtccagtcccaacactttgaactgcagtctggatgtggtgctcaaggaaggcggcgagatgaccacttgcaggcagtgcgtcgaggcttaccaggactatgaccaccatgctcaggagaaatacgaagagtttgaaagcgtgctccacaaatatttacagtcggaggagtactcggtgaaatcctgtcctgaagactgtaagattgtctacaaagcctggctctgttcccagtattttgaagtcacacagtttaactgcagaaagacaattccttgcaagcaatactgtttggaggttcagacgaggtgtccatttatattgcccgacaatgatgaagtcatctacggaggcctctccagtttcatctgtacagggctttatgaaacctttctaaccaatgatgaaccagaatgctgtgacgtcaggagagaagaaaaatcaaataacccatccaaagggaccgtagagaaaagtggctcctgtcacaggacatcgctcacagtgtcatcagcaacaagactgtgcaacagcagactcaagctgtgtgttcttgtactgattctcttacacacagtgctcacagcctcggcagcacagaacacagccggactgagctttggaggcatcaacacgctggaagaaaactcaaccaatgaggagtaacggaaggacgagtgtcaccacagcagcagctggcccgccgtgaaaaatggcaactgctgtctcatgtaacagaaactgggtgcttttaccctcgaattacttattgcaaggcctttagggtaaaatttaaacagatgggcctgaatccaaacaaggacacaaccacagctttttattgactaaaaggctggaaagtgactttaaatttctcacaccattttatacactgtgttttaatgtttggaggttttatttgctttcgttttggtttgggtttatttgtttgtttattttttgcacttgttaatacaggatttattttgggggatggtttctcagaggtaaactaagtcttttcactgtctctatctctctatatatttctagtcattgtgtgtgttcatcagatagttctgtctttatgtcctgtcagcttctattagaggaatgattgctatgacctcatggtatagcaaaaaacaacaacaaaaaaagaataaaaaataaaaaagacaaaaaaaagaaaacaacaaaaaaataaaaataaaaaaaatccctaagtctcccttctacccacagaaccaacaacacccttcccggcctttcctttccctcgccctcttctcgtcccctaagcaaacaacatccgcttgcttctgtctgtgtaaccacagtgaatgggtgtgcacgcttggtgggcctctgagcccctgttgcacaaaccagaaacagagcggagccaagggggcctgacaagagttcctttttagctgaacaaacaagtgctctccataataggtggaatcagacagttaacacatttttatgttgaaaacaaaataaaaggaaaaaattaaaaaaaactatcatgaactgtattgctccagttcccatccccaagtggcccagccctttcttgctggtccagttggacaggagcagctatctagaatcaggatgcggggagtgaggaagtttttcttttgacaatgaaggtgggctttcattgtgatttttgttctgttgcagtaatataggagcacattttggccattgtaattacagggaacaaacaaagggattgcggacacatatctggacttcttttcctcccttattgttgtggaagagacactagaaatgctcaaacacctgcaatatacagaatatacacaattttattccagtatttccctaacatatggtttaaaattattccaggtatacagtgtatgcaattctgcattatcacagaggaacaacttcttttttaaaaaataaataggtcagccatttttattaacgtgcaaaaactttatcactctaacatgctctaggtagttgaggaaaagaggtctgatcactgtttgtattttattttctttgtgggaacatttcacctgctgagtgtacatgaatttgctttctataaaaggcttttatgagtttacagtagaatcagtggaaggaagagttaataagggctgtttttaaaaaaacaaacaaacaaacaaaacaaataattaaaaaaaaaattttacattccttcctattctctaactacacttgggaagtgcacttcagataagtttgcagtgtgactgagagatgaaggaaatccatagaaaaggtcctcttagtgaacaaaatttagttattaactttatagctatgaaatttccccgggcatttgtttttgttcaaacagactttaacctctgcatcatacttaaccctgcgacatgcgtacagtatgcatattttgttttgaaaaaaaatgtttcgttccagtctgttaagaatattcaaaaataataaaggtattgcttaataaaattgctagaattgtttagcagtacatgcacaatattttactagattctttgttttaatagtgttttgttgagactgaaaatcttaaaatggtctgcgcaaatacaaaaaaaaagaaaacaccaaaaatgcaaaattctcccgtttttgttccttttttaaaatttttttttctgcaaatgcaaatacattcacatgtggacagatacatacacataggcatcatattttagtgtatggaaacatggtgcttttctggggacacaagctgaggaagtgaatggctcgggggagacacattaattgcatggaattgttgactgtgaaacacttgtagaaatgagcactttggtatcccaaccaatggtggaatacagatttcaatggcgctggggggacgagaagcagaggaattgaggctgcaagtgattcctgaggaagagctcacagggtgattttattcagatgacctctaagggaatggctaggaaggagtctgttctgacctttatctacctctgctgtggtaaggccactccatgtgccatctcaccatctcttcagcgttcctcatgctgcttctccccgtgccataggcgtttccattcttgcaggaaaatgacaatgcaagtgcaaattccactcacttttattggtatgacaataaattattctttctaaacacttagcaaaatgacgaaaagcagtattccttaaaatataggttttcattttctcaatatattttgaactgactaaagttctttacaaagacaagaggatcagaaggttccacttacccgtgttttagcgtttgtttggagataatgccaaccaaaaggtggaaaactaaaaccaccattgctttacataagaggtacacactgccccccaccccccaaaaaaaaacacagctttgaaagttgggagaaacactgcagtcttcattgtaaatataaagtgataatttaggtgaggaaggaacggtaaggagggaaggggaatgagtcctttctccccatcaagtcagccagcattggaatagtctctaattctggcggaatattttctttgtcatgttcatctattcttattacaggagaatgatttcagtgcctagtatttattagtgtaagtgtgtaaccactttcccgcaatatttccactggacatgttgaagcaaagcagcttcttctggggtcaggcagaggatccaaataggcaacgactcctttcccaagctcagaaacaatcactgatgatgcagatttcactacatccgttgattctttgtagtagttttcctggcacacacttgagcatgcttaaggttgtgcatatgttcattttgaacaaataagttcagcccctgctcctttgtaatcatcatcttgtttagtttttcctgtagaggatgtctaccgtatactggctaatgaactacaatattaaaataattatttctgcaagcaagttgaaaaccaagaaaacaatatttgtttcataaatgtatggcatagatttccctgtttattattctttttatctgcaatagagaaatttcagtttctggaatatgttggtactgctaagctaaatggcaaataacatagagttcaatgtcattctttattgcatttacatttggtgatacgttatattgaacttttcttgcattaaaaagatagtatttttcccctctctcacaaggcagtaagtgaaagttgttcttttaaatggcatcattacaaaaagtaatttggtttcttaccaataaattggtaccttaggtactagaacctgtagtcattaaaacaaaagaaaataggcagatagcagaaacaaaagaatgacaggaaagaaggaaggaaagaggggagtgagggagggagggaagaagggagggatagagtcggggaatgagggggaaaggaggtttcatatgaatgaataagtacatacttttttccgggggaaaaaaacataaatgaaataagcaattggatgccagacccatgtgccaaatacctgaattggcatatggtatttgatatctgaacaacatcaaaaacgttaaccagtctgaagcatgatttacattctttctcagtaacaaagacatttacaattttcctgctactcaaagcattaaatcaacacagaactgaaagctgcattttgttttatttatttagaactgcagtcaggtatttaatttcttttctgtgtgtttgtttgttttttgagatggcatcttgctctgttgctcaagctggaatgcagcggcaagatctctgctcactgcaacctccacttcctgggttcaagcgattctcctgcctcaagcctctcgagtagctgggactacaggcttgtgccaccacgcctggctaatttgtgtatttttagtagagacgtggtgtcgccatgttggccaggctagtcttgaactcctgaccttgggagatccgccgattaggcctcccaaagtgttgggattacaggcgtgagataccacacccagccaggtatttaatttcataagtgtgcatatgcatatatgaggcgttagggttatatactatggcatatctttagagagatataaagatatatatacatacacacacacacacacacacacacacacacacacatcgcttgcaaataaaacttcaaccaaaacattatgtagtccataacagcacatgtataccataatgatgaatgatcctacttgtttgtcaaagttagagcagcatggtcatttaaaaaccatatctactttgacaagggaaacagactctcaaaatatctccattaatgaataaatcacaattttgaaacaggcagaatctccatcttccaagctttaacaatgtttataaaaaacctaatatagcaggtaggtattgggtgacaatgaataaaaagactttcagtgggggggaaggaaaataactaagtatagttttcaagcaatgtcttcatgacatttataagaactatcaaacagctacaaattctagaaattctccaaataatgagaaaatgtatagataatcttcttagccttggaataaaacttaaggcatgaaacaaaatatgaactatggtttttattcttgagatactgtacttcagggctatgtttaccacagacaagacattcagattaaactcagaagaaaatcacctggttattttgtcctgggtcacacaggtaggtaatgcaaatgatggaactcaagcatcttctgattacaaattacacaagctggctccgaggcacagtgggatccctaggtctcagacacacttgaagagttgaatggattttcttcatactccaagatatttgtagaatcactcaatcttaaatgaaaaaatcaaaatgatcaggaagatctagcgaatgtctcagagttcgtttgtcatgttacattttgttccatgactttgctgtgttattcaatattttggaggtaaaggagaagagggtctatgggaatattttaataaaatatagatttttaatttttatttttaatgtggagaaaaggcacaggatcttagggcaaagccatggtttagggatgagctttggctccaggtgacacagggaggtcaatgatgtatttgtacgtgacacctcatgcaagaagaatacttcgtggcaacattggaggcttaaaagagataagtaatataaatgtgcctggacaaaacaggtgctcagtagtagttagttatcatgactattcattcacaaagtgaaactggattggcttgctcatagggactgctcctggaagttgttcagagtttctgaatttctttggcttatctcttaattacattttttttttaacaacacctcacatccttaagctagcagactgaccatcaatagattttcaatacagtttgaaagtcttaacatatattacagaactaaagtgagctctgatgacttttaatataaacagcattggctattttcgatttccactcccaaaaggctactactgacaagcaaaagttaaaggcatctacacaaattgaagtggttctacaagcaagtgtaaattgatcaacagtggtagtagaaataatgatgcaacttcaaagtggttgtttaaggcactcatagatcaaaaaatatatataaatatttgatgcctctgaattccttaaaaaaactatagtaattttaaacatgaaaatgtttaaattggaacatttattatgaaaattaattaaactgaattaatatatattttaattaacactataattattatagaatgaaataacagtgaaaaagttagaaaacctgttcagtttttgataaagtatatggaaatagattaagcagggctcttgagtaaattatttcattgatttgtatctatttaggtaggtgagagttgcatagaatcagtggcgagaaggatcagtgaaataaatttacaacttcagtgaagaccaggtaatgagcattgatctatgaatacagactttcttcagtgactatttcccctaaaactcccagctcaccgcagcactgctgcttcaagattccagttattggcgtgctagccaagtagaaggtcatttttaccgaaacgcaaatttcaacttatggccattttctactgaccatttcactgcaaaatggataaaacaataggaaatataaactacagcaaaagttaaagctctatatggacgttaaaagaaaacctcttgctttctttttcttcctttttctcttgttttctttttctacctttttctgcatatggcatttattttcatatcatgataagcattctcatgtttgcacttaattttccttatttctatttttcttagatttgttgatgttgtgtggcatattaaaagtaggaaggactgtataaactcatgtattatttttaaattgtttttctgaatgtactcaagtacttttttatgtgaatatgaacacggaataaaagtactaaaaccagttaattatgagagactaagaatgtggaaaggaacattccggagtatattagtagctaaagaaatgccttggatcttaaatttcaacttctaaaattattaaaatacaaatattaaaaagatatagaggccactgctaaa

SEQ ID NO: 132103 - DNA, 4013 bp, Homo sapiens
  Payload ID: 5788
  Gene Symbol: FAM155B
  Gene Name: family with sequence similarity 155, member B
  Uniprot ID: O75949
  ENST ID: ENST00000252338
  CDS Start-End: 43-1461
ctcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgccgctgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccctttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggctgtctacaaggcctggctgtgctcagaatacttcagcgtgacccagcaggaatgccagcgctgggtgccctgcaagcaatactgcctggaggtgcagacccggtgcccctttatactccccgacaatgaggaaatggtgtacggagggctccctggctttatctgtacagggttgctggatacttcaccaaagcgtctggaaaccaagtgctgtgacgtgcagtgggtctcctgtgaggcgaagaagaagaagttcaaggagtctgaggcccccaaaacccaccagcagcaattccaccactcctatttccaccactaccaccaacagtaccatcactaccacccccatcatgatcccccaggccgtgtcagcaacaagcccgccctgctgccggtctctgggggctcccgcctcagccctagcaggatccggctctgcgtccttgttctcatgctcctccataccgtggtgtccttctccagcaaccagggtggtgggggattggggctggagacactgcctgccctagaggagggcctgacacgggaagagtgacagtagggagggaggacagacctccaccacactgacatcagctccagctcccccaggttgggggggagggggctcctcccatgggaggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccctgccagttttctcatttattacagcctatcccccaaccctacccctgtgccctgcctacacactcccgtttggccctcagcactttgggcctggtcacataccccatccctagagtgctcttttcagctggggaggggaagaggtgctggctcctttccagacatgcttatgtataagtaaaggggcaggtgcttgggctccagagagaccctaggtactgccttctaactcctgcatcctcagaaggggaaaagggactgggaagtaaagggaaaccatatggccccagggaatggacccttggagactcccatcctctcttccccctcaccaagtgcccaggagacccctggctcagaccagcccaaggccttgcccagtggcaggggaaaggggcacctcactccacctcaaagtcatttgactgcccccatccaccccaccaccctaatcttccaccacctctccggctgcccctgccctccatcacagacagcagagccgggcagctttcttatgccattttctacactgtgcttcatgagtaggactttcttgcactagttcctatgactgagtctccaaactggtttcctagtagtcccccatcccttcctcccttacccagctatgattcagttgtctctgccctccctcttaccctgcctctgtgtttcggtgagagtctctgtatatgtactgctttctgttttgttgcattgtggggcagaggcctctctgctcttgtttaaccccataaagaaataaatggtaagacttgatgataa

SEQ ID NO: 132104 - DNA, 2942 bp, Homo sapiens
  Payload ID: 5789
  Gene Symbol: FAM156A
  Gene Name: family with sequence similarity 156, member A
  Uniprot ID: Q8NDB6
  ENST ID: ENST00000596733
  CDS Start-End: 1612-2253
gagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatgg

SEQ ID NO: 132105 - DNA, 848 bp, Homo sapiens
  Payload ID: 5789
  Gene Symbol: FAM156A
  Gene Name: family with sequence similarity 156, member A
  ENST ID: ENST00000622323
  CDS Start-End: 733-848
gattgcggagctgaagttcaggcagcgggagcgaggaggatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagcc

SEQ ID NO: 132106 - DNA, 2098 bp, Homo sapiens
  Payload ID: 5789
  Gene Symbol: FAM156A
  Gene Name: family with sequence similarity 156, member A
  Uniprot ID: Q8NDB6
  ENST ID: ENST00000615092
  CDS Start-End: 768-1409
agtttgtgacaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatgg

SEQ ID NO: 132107 - DNA, 567 bp, Homo sapiens
  Payload ID: 5789
  Gene Symbol: FAM156A
  Gene Name: family with sequence similarity 156, member A
  ENST ID: ENST00000622732
  CDS Start-End: 233-567
acgattgcggagctgaagttcaggcagcgggagcgaggagggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccag

SEQ ID NO: 132108 - DNA, 896 bp, Homo sapiens
  Payload ID: 5789
  Gene Symbol: FAM156A
  Gene Name: family with sequence similarity 156, member A
  ENST ID: ENST00000612846
  CDS Start-End: 343-896
gccacagattcccatctgcatctccaataccatttccctctactcactgacccgttgggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacagga

SEQ ID NO: 132109 - DNA, 865 bp, Homo sapiens
  Payload ID: 5789
  Gene Symbol: FAM156A
  Gene Name: family with sequence similarity 156, member A
  ENST ID: ENST00000619586
  CDS Start-End: 854-865
ggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactc

SEQ ID NO: 132110 - DNA, 2635 bp, Homo sapiens
  Payload ID: 5789
  Gene Symbol: FAM156A
  Gene Name: family with sequence similarity 156, member A
  Uniprot ID: Q8NDB6
  ENST ID: ENST00000613284
  CDS Start-End: 208-849
agcgggcggcgctgcgtttccagggcagaggaaacgaggcgccgcgttggcgcttggacggcgggaaccggctccggagcgagaacgcgctctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcatctgttttaggtagtccccagagctgtcttgctgcaaaagtctacacatctcctgccgacagaagtggcttgaaaacaggcttatgaagctaatgtcacctattggctctgctcaccttttcctgtcaattgtattttacaactcctccatttcctaccctggaagaaatctctccaccagtacggctgccatttgaggcatattcccatacaaactggacctctgacgactctaaaaaaggaacacaccctacccaggatacgcaccaaaggagatgaacttgtttttatccaaaggaagtgtttgtttgtaatcataaatttgtgagcctaagctactgcaaaggaaactggccaggttattagcccaaatgaaggcagtgggtaacttgggtttagccccaacaccagccgcacctaggaaagttacatgataaattgtgacaattgtttttttcccccccggagaataccaaagcaattcatactttgttgtgggttcactgcctttttttttttaaccagccaattggatagtcatgttatcttacccatctctttctccctttctgattatacatttgcatagagttatgacaacttaccaccttttcagaagtagagtaaaactctcactcctagacagaacaatccattgtcaggagtgagaacatccctctgcaaaacagccattctctccaggaaaacaacaggaactgtctgaagaagctaaaagacttggaatggttttagatgtgttcgcccccaacagggacaggtctcaggttgcaggcttttctggcaatccagctctgtgggttactgaagaagctcaacccaattcctgagttttccatgctctcattcatgaagccaaccaagtcaccagtgatgtcacgaaaaatattaacacaatcactcaagaaatgcaagaactccagaggctgttgtccatcatcaactggcattagccatcatccgggcagatctaggagatggatgcacttgtgcagttgtcaatgacgactgctgtacatatatcccccaacacctttctgatgtctttttgatgaattgccacctagtcctgatctctgggacctctgggttatcattgggtggctgagaatatgaccttttcccttgaatattcccaacagggatacagtcctggggatgcactgcttttccaagatatagtgataatttttctttttattctcataggaatactcctcatgaagtctatccagtcacatctagttaagaccagcagcactctcctgtccaaatggatgacccatgttacgactaaggaacagaagaccaaataacaaactgctcctcagatccattatggaggccttcttggctcaattcctgaatatgatatatccttataattttgttttctctccaaaaaagaatatgctggcaatgaaa

SEQ ID NO: 132111 - DNA, 1685 bp, Homo sapiens
  Payload ID: 5789
  Gene Symbol: FAM156A
  Gene Name: family with sequence similarity 156, member A
  Uniprot ID: Q8NDB6
  ENST ID: ENST00000611661
  CDS Start-End: 351-992
acaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 132112 - DNA, 2032 bp, Homo sapiens
  Payload ID: 5789
  Gene Symbol: FAM156A
  Gene Name: family with sequence similarity 156, member A
  Uniprot ID: Q8NDB6
  ENST ID: ENST00000617970
  CDS Start-End: 698-1339
aattacgagcgggcggcgctgcgtttccagggcagaggaaacgaggcgccgcgttggcgcttggacggcgggaaccggctccggagcgagaacgcgcatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 132113 - DNA, 753 bp, Homo sapiens
  Payload ID: 5789
  Gene Symbol: FAM156A
  Gene Name: family with sequence similarity 156, member A
  ENST ID: ENST00000622197
  CDS Start-End: 360-753
ggcgcttggacggcgggaaccggctccggagcgagaacgcgcccgcttatgagaatatgaaactaaggagagccacaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgcc

SEQ ID NO: 132114 - DNA, 3757 bp, Homo sapiens
  Payload ID: 5789
  Gene Symbol: FAM156A
  Gene Name: family with sequence similarity 156, member A
  Uniprot ID: Q8NDB6
  ENST ID: ENST00000622447
  CDS Start-End: 2423-3064
gctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 132115 - DNA, 644 bp, Homo sapiens
  Payload ID: 5789
  Gene Symbol: FAM156A
  Gene Name: family with sequence similarity 156, member A
  ENST ID: ENST00000619518
  CDS Start-End: 399-644
gatggtcttaacccttcaattacgagcgggcggcgctgcgtttccagggcagaggaaacgaggcgccgcgttggcgcttggacggcgggaaccggctccggagcgagaacgcgcgtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggag

SEQ ID NO: 132116 - DNA, 992 bp, Homo sapiens
  Payload ID: 5789
  Gene Symbol: FAM156A
  Gene Name: family with sequence similarity 156, member A
  ENST ID: ENST00000618601
  CDS Start-End: 825-992
gttggaaaaaagtcagaggctgagtcgttccaacatggcgcagatgccacaaggacactagcacaccagcaggaagctgaacagaaggctggaggtgccacggtgacaaggacgggatcctgtcaggccagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtg

SEQ ID NO: 132117 - DNA, 2233 bp, Homo sapiens
  Payload ID: 5789
  Gene Symbol: FAM156A
  Gene Name: family with sequence similarity 156, member A
  Uniprot ID: Q8NDB6
  ENST ID: ENST00000612915
  CDS Start-End: 903-1544
agtttgtgacaggcacgacgattgcggagctgaagttcaggcagcgggagcgaggaggattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatgg

SEQ ID NO: 132118 - DNA, 510 bp, Homo sapiens
  Payload ID: 5789
  Gene Symbol: FAM156A
  Gene Name: family with sequence similarity 156, member A
  ENST ID: ENST00000610625
  CDS Start-End: 501-510
caactgacagtcccaaaggggctggagatgccaccccggcaaagttcgccctagtcatttgcttcacgccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccac

SEQ ID NO: 132119 - DNA, 914 bp, Homo sapiens
  Payload ID: 5789
  Gene Symbol: FAM156A
  Gene Name: family with sequence similarity 156, member A
  ENST ID: ENST00000619373
  CDS Start-End: 535-914
ccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtga

SEQ ID NO: 132120 - DNA, 569 bp, Homo sapiens
  Payload ID: 5789
  Gene Symbol: FAM156A
  Gene Name: family with sequence similarity 156, member A
  ENST ID: ENST00000612083
  CDS Start-End: 465-569
ctgaagttcaggcagcgggagcgaggaggattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtac

SEQ ID NO: 132121 - DNA, 1931 bp, Homo sapiens
  Payload ID: 5789
  Gene Symbol: FAM156A
  Gene Name: family with sequence similarity 156, member A
  Uniprot ID: Q8NDB6
  ENST ID: ENST00000623782
  CDS Start-End: 601-1242
agtttgtgacaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatgg

SEQ ID NO: 132122 - DNA, 1701 bp, Homo sapiens
  Payload ID: 5790
  Gene Symbol: FAM156B
  Gene Name: family with sequence similarity 156, member B
  Uniprot ID: Q8NDB6
  ENST ID: ENST00000509613
  CDS Start-End: 367-1008
accgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 132123 - DNA, 2537 bp, Homo sapiens
  Payload ID: 5790
  Gene Symbol: FAM156B
  Gene Name: family with sequence similarity 156, member B
  Uniprot ID: Q8NDB6
  ENST ID: ENST00000416841
  CDS Start-End: 1203-1844
ttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 132124 - DNA, 2942 bp, Homo sapiens; identical to SEQ ID NO: 132104
  Payload ID: 5790
  Gene Symbol: FAM156B
  Gene Name: family with sequence similarity 156, member B
  Uniprot ID: Q8NDB6
  ENST ID: ENST00000593751
  CDS Start-End: 1612-2253

SEQ ID NO: 132125 - DNA, 992 bp, Homo sapiens; identical to SEQ ID NO: 132116
  Payload ID: 5790
  Gene Symbol: FAM156B
  Gene Name: family with sequence similarity 156, member B
  ENST ID: ENST00000619346
  CDS Start-End: 825-992

SEQ ID NO: 132126 - DNA, 545 bp, Homo sapiens
  Payload ID: 5790
  Gene Symbol: FAM156B
  Gene Name: family with sequence similarity 156, member B
  ENST ID: ENST00000610609
  CDS Start-End: 535-545
ccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccact

SEQ ID NO: 132127 - DNA, 776 bp, Homo sapiens
  Payload ID: 5790
  Gene Symbol: FAM156B
  Gene Name: family with sequence similarity 156, member B
  ENST ID: ENST00000612188
  CDS Start-End: 389-776
acccttcaattacgagcgggcggcgctgcgtttccagggcagaggaaacgaggcgccgcgttggcgcttggacggcgggaaccggctccggagcgagaacgcgcgtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgat

SEQ ID NO: 132128 - DNA, 2032 bp, Homo sapiens; identical to SEQ ID NO: 132112
  Payload ID: 5790
  Gene Symbol: FAM156B
  Gene Name: family with sequence similarity 156, member B
  Uniprot ID: Q8NDB6
  ENST ID: ENST00000616419
  CDS Start-End: 698-1339

SEQ ID NO: 132129 - DNA, 858 bp, Homo sapiens
  Payload ID: 5790
  Gene Symbol: FAM156B
  Gene Name: family with sequence similarity 156, member B
  ENST ID: ENST00000610405
  CDS Start-End: 710-858
actttggaaaagctttggccgagaggaagggtccattcagatggttggggagtggggcttagaattttatttttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcc

SEQ ID NO: 132130 - DNA, 748 bp, Homo sapiens
  Payload ID: 5791
  Gene Symbol: FAM159A
  Gene Name: family with sequence similarity 159, member A
  Uniprot ID: Q6UWV7
  ENST ID: ENST00000517870
  CDS Start-End: 151-723
gtctctgtctcggcttctctcggcccctgggtctcttcgtctctgccgttctcaggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcagcattggcgctctcataggcctgtccgtagcagcagtggttcttctcgccttcattgttaccgcctgtgtgctctgctacctgttcatcagctctaagccccacacaaagttggacctgggcttgagcttacagacagcaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtctccatacca

SEQ ID NO: 132131 - DNA, 847 bp, Homo sapiens
  Payload ID: 5792
  Gene Symbol: FAM159B
  Gene Name: family with sequence similarity 159, member B
  Uniprot ID: A6NKW6
  ENST ID: ENST00000389074
  CDS Start-End: 317-799
ggggacagctaaggtctccaggctgctgatgaagtgagggaaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcagcattggtgccttgattggactaggaattgctgcccttgttttactcgcctttgtcatcagtgtctgtgtcctttgctatttatttctgtatacgaaacctcaaagattagacactggccttaagcttcaacacttagaggcttcttccactcaagaaggcaagtcaaatggaaaaaccaaagccctcaattcaaatgcagcatcaaatgcaacaaatgaaacatactatgaagctgatgatataattcaagaaaaaacaatggatgcaacacaaatccacattgcttattaactaaaaattctgtgttttaaatgcttactggagagatgggacaataaa

SEQ ID NO: 132132 - DNA, 612 bp, Homo sapiens
  Payload ID: 5792
  Gene Symbol: FAM159B
  Gene Name: family with sequence similarity 159, member B
  ENST ID: ENST00000506473
  CDS Start-End: 93-305
gcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcaggtcaaacttgtcagtgtcctaatcccagagaaagagcagaagcctaaaggcaagccaggaagataatgaagaaaaagatcattacttttcaatgaccattggtgccttgattggactaggaattgctgcccttgttttactcgcctttgtcatcagtgtctgtgtcctttgctatttatttctgtatacgaaacctcaaagattagacactggccttaagcttcaacacttagaggcttcttccactcaagaaggcaagtcaaatggaaaaaccaaagccctcaattcaaatgcagcatcaaatgcaacaaatgaaacatactatgaag

SEQ ID NO: 132133 - DNA, 846 bp, Homo sapiens
  Payload ID: 5792
  Gene Symbol: FAM159B
  Gene Name: family with sequence similarity 159, member B
  ENST ID: ENST00000509189
  CDS Start-End: 183-395
tgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcaggtcaaacttgtcagtgtcctaatcccagagaaagagcagaagcctaaaggcaagccaggaagataatgaagaaaaagatcattacttttcaatgacgtatgttccaaatacagcattggtgccttgattggactaggaattgctgcccttgttttactcgcctttgtcatcagtgtctgtgtcctttgctatttatttctgtatacgaaacctcaaagattagacactggccttaagcttcaacacttagaggcttcttccactcaagaaggcaagtcaaatggaaaaaccaaagccctcaattcaaatgcagcatcaaatgcaacaaatgaaacatactatgaagctgatgatataattcaagaaaaaacaatggatgcaacacaaatccacattgcttattaactaaaaattctgtgttttaaatgcttactggagagatgggacaataaaaataaagcgtgcacttgaaa

SEQ ID NO: 132134 - DNA, 4576 bp, Homo sapiens
  Payload ID: 5793
  Gene Symbol: FAM160A1
  Gene Name: family with sequence similarity 160, member A1
  Uniprot ID: Q05DH4
  ENST ID: ENST00000435205
  CDS Start-End: 576-3698
acattcttcccgggcactcctgagtttgagccgggcctggaggacctgggccaagactttcgagcggcggccgcccgaggtgcgaggagccagcccggctttcctcactgggtcccgcgcaggcgtccccgggaccgcagagcaaactttctggactatctgaggacacttgtccagcgagccccactgctcggggaggaggagccacggccggggacaggtgatacacttgggtgttgaaggacatttttgaaatcatgagaactcaatgtttgactatgaatgtttcgttataactgcctggaaggttagcgtcaaagaagttgagatttttaaagtcttcttctaggggtttccagcagagccaaatgttagaaaaatctttccgctcctctgaagagtgaagtgagcaaatacaacccagcagtaggttattgaagacagcagccccaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgaggccagtgccgtgcagaattacgtagaacacatgctcttcttgttgattgaagagcaagccaaagatgctgcaatggggccgattctggaatttgtggtctctgagaacatcatggagaaacttttcctttggagcttgagaagggagtttactgatgagactaaaattgagcagctaaagatgtatgagatgttggtcacccagtcgcaccagcctctgctgcaccacaaacccattctgaagcctctgatgatgttgctgagctcttgttcaggaacaaccacccccactgtggaggagaagctggttgtcctactcaatcagctctgttccattcttgccaaagatccatccattttagaactcttcttccacactagtgaagaccaaggcgctgccaacttcctcatcttctcccttctgattcccttcattcaccgagaggggtcagtaggccagcaagctcgggatgcattgctcttcatcatgtctctttctgctgagaacaccatggtggcccatcacatcgtggagaacacctacttttgtccagtacttgcaactgggctcagtggtctctactcttccctgcctacaaagctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataaggtgactgtggaagaggtcatgaccacaactgcatatctggaccttttcctgcgtagcatctccgagccagcactacttgagatcttcctccgttttatcctattgcaccagcacgagaatgtccacatcctagacactctcacgagtcgaatcaacaccccgtttcggctttgtgtggtgtctctggcattattcagaactctcattggtttacattgtgaagatgtgatgttacagctagttctaaggtatctgatcccctgcaatcacatgatgctgagtcagaggtgggctgtgaaggagagagactgttactctgtttctgcggccaagcttctcgccttgactcctgtctgctgctccagcgggatcactctgacgctggggaaccaagagagggattatattctctggtcaaagtgtatgcatgacacttcagggcctgtggagcggccattccccgaagcgttctccgagtcagcctgcattgtggagtatgggaaagccctggacatcagctacctgcagtacctgtgggaggcccacaccaacatcctccgctgcatgagggactgccgtgtctggtccgccctgtatgatggcgactcccccgaccctgagatgtttctccagagtctgacggaggagggcagtgtgagctcggcctgccctgtgttcgggctcccgcaacaactccccaggaagacaggacctcagctggctcccagaaaggacaagagccagacagagctggaatgggatgacagctatgacactggaatctcctcaggggctgacgtgggctccccagggccttatgatgatctggaggtttcaggccccccagcacccattgatccccccaaacacatccaggagatgaagaagaatgccctcctgctcttcaaagggtcctacatagaagagtcggactttcaggatgatgtgatggtgtacaggctgtgtgctgagaaggactccgaggacatgaaggattctcaggaggaagctgctaggccaccagctgaagcccaggctgaagttcagagtgtccccatcaacaacggccccctcctcagcacccagccagagacagattcagaggaggagtggaatagggacaattcagacccgtttcacagtgagcccaaggagccaaagcaagagagggaacctgaagcagccccagaatccaactcagagttagcatcccctgcccctgaggcagagcacagctctaacctgacagccgcccacccggagagcgaggagctcattgcccagtatgaccaaatcattaaagagctggattccggcgccgagggcttgatggaacagaattaccccacacctgatcccttgcttctcactaaggaggaagaagggaaggaagagagtaaaggagaaaaggagaaggaggggaagaaggagctagaagatgaggaggatgactttgactcttttatagcggagatgcctgctgtagagactgtgccttccccatttgtggggagagatgaggctgcctttgccagtcgccatcccgtgaggactcaaagcaccccattcacaggcccattcatcagcgtagtcctgtcaaagctggagaacatgctggagaactctttacatgttaatttgctgcttatcgggatcattactcagctagccagctacccccagccactcctgcgctcctttctgctcaacaccaacatggtcttccagccaagcgtccgctctctctatcaggtccttgcatctgtgaaaaacaagattgaacagtttgcttctgtggagagagacttcccagggctcctcattcaagctcagcagtacctgctcttccgtgtggacatgtctgatatgacccctgcagcactaaccaaagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagcttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttcttgcagctcagatcacgtcaagcagatattggggttcagtgatgtctggtgatgtctggaagtgccccatgtcagaattccagctgttcagcagcacaggaagattgtacacctgcaactgtgcgaatggtcctgttgcctcctgcattttggcctctgttctataaaggaagagtaaagatggagctcctcctgcctccatcacgaaagcacatatcatctgtccctttggattttacttccaggacgtgtgtcgtccccagcgtgtgttgccttatggtgccggcagagcctcagctatctgcctgggaagtcggatgtccttggagagaatttggaatgcagataatttttcttatttcttgagagcttactttaatcagcatgacactacctaaacactgaagatggccttatattagtaagatttgcacaaaattaagtatacctatgcaaactattactttggtttttaggagtttgatcagatgaagaagtaatggtatcacatatatatgtaagaagacaaccatcattatttttgtaagtgttttataaaaacaaactgattaacttg

SEQ ID NO: 132135 - DNA, 4156 bp, Homo sapiens
  Payload ID: 5793
  Gene Symbol: FAM160A1
  Gene Name: family with sequence similarity 160, member A1
  Uniprot ID: Q05DH4
  ENST ID: ENST00000505231
  CDS Start-End: 160-3282
cagccaaaccatatcaaccttattgatgtttttgcaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgaggccagtgccgtgcagaattacgtagaacacatgctcttcttgttgattgaagagcaagccaaagatgctgcaatggggccgattctggaatttgtggtctctgagaacatcatggagaaacttttcctttggagcttgagaagggagtttactgatgagactaaaattgagcagctaaagatgtatgagatgttggtcacccagtcgcaccagcctctgctgcaccacaaacccattctgaagcctctgatgatgttgctgagctcttgttcaggaacaaccacccccactgtggaggagaagctggttgtcctactcaatcagctctgttccattcttgccaaagatccatccattttagaactcttcttccacactagtgaagaccaaggcgctgccaacttcctcatcttctcccttctgattcccttcattcaccgagaggggtcagtaggccagcaagctcgggatgcattgctcttcatcatgtctctttctgctgagaacaccatggtggcccatcacatcgtggagaacacctacttttgtccagtacttgcaactgggctcagtggtctctactcttccctgcctacaaagctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataaggtgactgtggaagaggtcatgaccacaactgcatatctggaccttttcctgcgtagcatctccgagccagcactacttgagatcttcctccgttttatcctattgcaccagcacgagaatgtccacatcctagacactctcacgagtcgaatcaacaccccgtttcggctttgtgtggtgtctctggcattattcagaactctcattggtttacattgtgaagatgtgatgttacagctagttctaaggtatctgatcccctgcaatcacatgatgctgagtcagaggtgggctgtgaaggagagagactgttactctgtttctgcggccaagcttctcgccttgactcctgtctgctgctccagcgggatcactctgacgctggggaaccaagagagggattatattctctggtcaaagtgtatgcatgacacttcagggcctgtggagcggccattccccgaagcgttctccgagtcagcctgcattgtggagtatgggaaagccctggacatcagctacctgcagtacctgtgggaggcccacaccaacatcctccgctgcatgagggactgccgtgtctggtccgccctgtatgatggcgactcccccgaccctgagatgtttctccagagtctgacggaggagggcagtgtgagctcggcctgccctgtgttcgggctcccgcaacaactccccaggaagacaggacctcagctggctcccagaaaggacaagagccagacagagctggaatgggatgacagctatgacactggaatctcctcaggggctgacgtgggctccccagggccttatgatgatctggaggtttcaggccccccagcacccattgatccccccaaacacatccaggagatgaagaagaatgccctcctgctcttcaaagggtcctacatagaagagtcggactttcaggatgatgtgatggtgtacaggctgtgtgctgagaaggactccgaggacatgaaggattctcaggaggaagctgctaggccaccagctgaagcccaggctgaagttcagagtgtccccatcaacaacggccccctcctcagcacccagccagagacagattcagaggaggagtggaatagggacaattcagacccgtttcacagtgagcccaaggagccaaagcaagagagggaacctgaagcagccccagaatccaactcagagttagcatcccctgcccctgaggcagagcacagctctaacctgacagccgcccacccggagagcgaggagctcattgcccagtatgaccaaatcattaaagagctggattccggcgccgagggcttgatggaacagaattaccccacacctgatcccttgcttctcactaaggaggaagaagggaaggaagagagtaaaggagaaaaggagaaggaggggaagaaggagctagaagatgaggaggatgactttgactcttttatagcggagatgcctgctgtagagactgtgccttccccatttgtggggagagatgaggctgcctttgccagtcgccatcccgtgaggactcaaagcaccccattcacaggcccattcatcagcgtagtcctgtcaaagctggagaacatgctggagaactctttacatgttaatttgctgcttatcgggatcattactcagctagccagctacccccagccactcctgcgctcctttctgctcaacaccaacatggtcttccagccaagcgtccgctctctctatcaggtccttgcatctgtgaaaaacaagattgaacagtttgcttctgtggagagagacttcccagggctcctcattcaagctcagcagtacctgctcttccgtgtggacatgtctgatatgacccctgcagcactaaccaaagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagcttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttcttgcagctcagatcacgtcaagcagatattggggttcagtgatgtctggtgatgtctggaagtgccccatgtcagaattccagctgttcagcagcacaggaagattgtacacctgcaactgtgcgaatggtcctgttgcctcctgcattttggcctctgttctataaaggaagagtaaagatggagctcctcctgcctccatcacgaaagcacatatcatctgtccctttggattttacttccaggacgtgtgtcgtccccagcgtgtgttgccttatggtgccggcagagcctcagctatctgcctgggaagtcggatgtccttggagagaatttggaatgcagataatttttcttatttcttgagagcttactttaatcagcatgacactacctaaacactgaagatggccttatattagtaagatttgcacaaaattaagtatacctatgcaaactattactttggtttttaggagtttgatcagatgaagaagtaatggtatcacatatatatgtaagaagacaaccatcattatttttgtaagtgttttataaaaacaaactgattaa

SEQ ID NO: 132136 - DNA, 548 bp, Homo sapiens
  Payload ID: 5793
  Gene Symbol: FAM160A1
  Gene Name: family with sequence similarity 160, member A1
  ENST ID: ENST00000512597
  CDS Start-End: 369-548
atacaacccagcagtaggttattgaagacagcagccccagtgaaattctagagaatccaagaacaagttaatcctcagtgttgattagcagcattagtgagcatggagaaaatggatcactagttattggagtttaaagcagtacaacttttgaggagtccgtttacatcaaaagccttcagatattcctactctttgagctgatgtttccacttctgggattctaattgaaggacaaaatcatgggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgag

SEQ ID NO: 132137 - DNA, 570 bp, Homo sapiens
  Payload ID: 5793
  Gene Symbol: FAM160A1
  Gene Name: family with sequence similarity 160, member A1
  ENST ID: ENST00000503146
  CDS Start-End: 451-570
acattcttcccgggcactcctgagtttgagccgggcctggaggacctgggccaagactttcgagcggcggccgcccgaggtgcgaggagccagcccggctttcctcactgggtcccgcgcaggcgtccccgggaccgcagagcaaactttctggactatctgaggacacttgtccagcgagccccactgctcggggaggaggagccacggccggggacaggtgatacacttgggtgttgaaggacatttttgaaatcatgagaactcaatgtttgactatgaatgtttcgttataactgcctggaaggttagcgtcaaagaagttgaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttg

SEQ ID NO: 132138 - DNA, 401 bp, Homo sapiens
  Payload ID: 5793
  Gene Symbol: FAM160A1
  Gene Name: family with sequence similarity 160, member A1
  ENST ID: ENST00000513086
  CDS Start-End: 362-401
actgggtcccgcgcaggcgtccccgggaccgcagagcaaactttctggactatctgaggacacttgtccagcgagccccactgctcggggaggaggagccacggccggggacagatttttaaagtcttcttctaggggtttccagcagagccaaatgttagaaaaatctttccgctcctctgaagagtgaagtgagcaaatacaacccagcagtaggttattgaagacagcagccccaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcagg

SEQ ID NO: 132139 - DNA, 565 bp, Homo sapiens
  Payload ID: 5793
  Gene Symbol: FAM160A1
  Gene Name: family with sequence similarity 160, member A1
  ENST ID: ENST00000513962
  CDS Start-End: 439-565
agcaaagcttagagtccctctaagctgaacatctacaacacttctcttctggctctcattctaccttgtggctacagttactggtgatacacttgggtgttgaaggacatttttgaaatcatgagaactcaatgtttgactatgaatgtttcgttataactgcctggaaggttagcgtcaaagaagttgagatttttaaagtcttcttctaggggtttccagcagagccaaatgttagaaaaatctttccgctcctctgaagagtgaagtgagcaaatacaacccagcagtaggttattgaagacagcagccccaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagc

SEQ ID NO: 132140 - DNA, 3481 bp, Homo sapiens
  Payload ID: 5794
  Gene Symbol: FAM160A2
  Gene Name: family with sequence similarity 160, member A2
  Uniprot ID: Q8N612
  ENST ID: ENST00000265978
  CDS Start-End: 360-3320
agtcgtgcgacgccgggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctatctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtgggcctagcagagagacagggagaagggaggacatcacgggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 132141 - DNA, 3354 bp, Homo sapiens
  Payload ID: 5794
  Gene Symbol: FAM160A2
  Gene Name: family with sequence similarity 160, member A2
  Uniprot ID: Q8N612
  ENST ID: ENST00000449352
  CDS Start-End: 265-3183
gcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctatctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctctattctgtgctc

SEQ ID NO: 132142 - DNA, 3327 bp, Homo sapiens
  Payload ID: 5794
  Gene Symbol: FAM160A2
  Gene Name: family with sequence similarity 160, member A2
  ENST ID: ENST00000524416
  CDS Start-End: 312-2828
gcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctatctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggtaagctacttagcctaggccttcccttctgtgtactctttgcatgttctcgacatgtttgtgctggtttcttggacctcttggccatgtcatttctgtgtacttgcctagcccctcatccatcctgcttgcatcacttccagatacgtgtcatgtcatacttgtgtccctgtgtctgtctgtacgtcttccatgcttgtgctggtttgagtattgacttacatctgagccttgtatgtatgtcctatgtgcatgttcctcctctttccctagtctggccatttcctgcgatttgtaattaggatattctgtgtttgatgtttcctggtgaatcacagcaatatttctgaaccatattgaagacgtatgtgctgtcctgtatggagaggcacctaaacactctctatgccattccgtccagtttatctgtctgggtcttgggttttctgtcagctctcctggggcctaaggttaaccttctggtatttttctccctactcagctccttcctccccacctcttcaaagaaggacttgatttcaagtttttcctgttcgctttccttgtaccttcttggttgctgtgactgtctgctagcactaagactgtcttaagcagatagagtgcaatttctttgaaggcaaatgacaaagcgtggccctgagctccctgactgagttcatttggactctcaaggatgccctggagctagactcgatctgagtggttggactaactcctctttgtttttgtatgagagccagcttaccccgccattctaaacctcaggccaggaaaacc

SEQ ID NO: 132143 - DNA, 666 bp, Homo sapiens
  Payload ID: 5795
  Gene Symbol: FAM160B1
  Gene Name: family with sequence similarity 160, member B1
  ENST ID: ENST00000369246
  CDS Start-End: 310-615
gaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgatgtaagttcctgatccacaccatgttcttgggcattagtacatgcattaatgtcttacgaataa

SEQ ID NO: 132144 - DNA, 5810 bp, Homo sapiens
  Payload ID: 5795
  Gene Symbol: FAM160B1
  Gene Name: family with sequence similarity 160, member B1
  Uniprot ID: Q5W0V3
  ENST ID: ENST00000369248
  CDS Start-End: 336-2633
gcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaaattaattagactctgtggtgaagtcctagcaacaccaacagaaaatgaagagattcagtttctttgcattgtgtgtgcgaagctgaaacaggacccctacctggttaactttttcctagagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctattattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaaaa

SEQ ID NO: 132145 - DNA, 2870 bp, Homo sapiens
  Payload ID: 5795
  Gene Symbol: FAM160B1
  Gene Name: family with sequence similarity 160, member B1
  Uniprot ID: Q5W0V3
  ENST ID: ENST00000369250
  CDS Start-End: 336-2552
gcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaaattaattagactctgtggtgaagtcctagcaacaccaacagaaaatgaagagattcagtttctttgcattgtgtgtgcgaagctgaaacaggacccctacctggttaactttttcctagagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctatgcagacgttgccttcatggtggtaagagggattccagagtctcttatgtcctcaaagcttcaagctcagccaaaagaatctcgatggtttccacaaaaaatcttgggccttggatcaactgcccacccttgaaccaatcctggtggccccaggctgattggcagacctgaatcacctatcccatgcccagaactttggcttgaccaggctcatccaaaacaagggaatccagagtgtttccccaaagaaaatcagggggctattactgggaaaaagaattccaccacaagtataaaaaatactgttatcaataaaacatcacctgatactttggttcattaaa

SEQ ID NO: 132146 - DNA, 469 bp, Homo sapiens
  Payload ID: 5795
  Gene Symbol: FAM160B1
  Gene Name: family with sequence similarity 160, member B1
  ENST ID: ENST00000411414
  CDS Start-End: 1-252
ctttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctatttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaa

SEQ ID NO: 132147 - DNA, 4245 bp, Homo sapiens
  Payload ID: 5796
  Gene Symbol: FAM160B2
  Gene Name: family with sequence similarity 160, member B2
  Uniprot ID: Q86V87
  ENST ID: ENST00000289921
  CDS Start-End: 47-2278
gctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtggacaccgtggctctgttcttggccaagtttccccaccttctgcccaggactccactgctaattcgggcccatcttcctccccaaggaagacaaattctttttctagcgctgcagcagggaggtggggtgggcggtaaacagacaggctctggcagtgcagatctgctgatcctcagcgcctgccaggagccagactcttggcggagcagtgccacttctgctgggctgacctgcagcggagagtctgcccaccccggagacaccatgagggaatggaccacgtgggagcatctgtgtgcaagtctcatttgggtgtgtttatgctgcgtgttgtatgcctgttttagtcataaagtaggcctgatatttaaaaccttgtctttaagttcaaggctgcagtgagccgattgcaccactgcactccagcctgggcaatagagtaagaccctgtctaaaaaaaaaaaaaaaaaatttcacaggtgtgttctcagggaaaaagaaaagttaacacataaataaa

SEQ ID NO: 132148 - DNA, 932 bp, Homo sapiens
  Payload ID: 5796
  Gene Symbol: FAM160B2
  Gene Name: family with sequence similarity 160, member B2
  ENST ID: ENST00000427751
  CDS Start-End: 71-226
ggggctgcctcctccgcctagagcgctgccgccgccgctttcgcccgggagccgggggccgggcgccatcatgctgagccggctcggggcgctgctgcaggaagccgtgggggcgacaactccaggaccttgttggggtgcaggacgcccttcccgtcaccccgggacgtgggaagtgcaggccctgccggtccaagtccccacgaaggcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaag

SEQ ID NO: 132149 - DNA, 2846 bp, Homo sapiens
  Payload ID: 5796
  Gene Symbol: FAM160B2
  Gene Name: family with sequence similarity 160, member B2
  Uniprot ID: Q86V87
  ENST ID: ENST00000450006
  CDS Start-End: 47-2278
gctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtggaca

SEQ ID NO: 132150 - DNA, 1897 bp, Homo sapiens
  Payload ID: 5797
  Gene Symbol: FAM161A
  Gene Name: family with sequence similarity 161, member A
  ENST ID: ENST00000307507
  CDS Start-End: 24-251
gctcaggcctcggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggctcagcccgctggggcatcgagatggggtttcaccatgttggccagattggtctcggattcctgacctcaagtgacccaaagtgctgggattacaggcatgaaccactgtgcctggccaattctgttgatttttcgagtgaaaactgcatactggattcagacactgctactaaaacgaactgctgctgcccagatgaataaccgttgctagactgacacaagccgacaggaagcagtcagagggctaacagaaaggagctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgtggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagag

SEQ ID NO: 132151 - DNA, 3762 bp, Homo sapiens
  Payload ID: 5797
  Gene Symbol: FAM161A
  Gene Name: family with sequence similarity 161, member A
  Uniprot ID: Q3B820
  ENST ID: ENST00000404929
  CDS Start-End: 13-2163
ggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggctcagcccgctggggcatcggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgtggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaaggagatcacttgaggaaaagaaaatgttggaagaagagagaaatcggatcctaactaaacagaagcaaagaatgaaagaattgcagaaactcctgacaacccgggctaaggcttatgactcacatcaaagtttagctcaaatatctaaatccagagtaaaatgtctcagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacattatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgtgagttataatctaaattaggggcaagtatccctttttttatatgatgaaattgtgcataataacttggctagggcaagtctccaaagtaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtg

SEQ ID NO: 132152 - DNA, 3684 bp, Homo sapiens
  Payload ID: 5797
  Gene Symbol: FAM161A
  Gene Name: family with sequence similarity 161, member A
  Uniprot ID: Q3B820
  ENST ID: ENST00000405894
  CDS Start-End: 103-2085
atagcaaccggctccctagctaggcgcccccgggttgccaggggccgcaccagctttcccgtcccgggccagcgcaggcgctcaggcctcggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggctcagcccgctggggcatcggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgtggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacattatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgtgagttataatctaaattaggggcaagtatccctttttttatatgatgaaattgtgcataataacttggctagggcaagtctccaaagtaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtg

SEQ ID NO: 132153 - DNA, 3579 bp, Homo sapiens
  Payload ID: 5797
  Gene Symbol: FAM161A
  Gene Name: family with sequence similarity 161, member A
  ENST ID: ENST00000456262
  CDS Start-End: 52-480
agctttcccgtcccgggccagcgcaggcgctcaggcctcggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggctcagcccgctggggcatcggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgtggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacattatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgtgagttataatctaaattaggggcaagtatccctttttttatatgatgaaattgtgcataataacttggctagggcaagtctccaaagtaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtgta

SEQ ID NO: 132154 - DNA, 4027 bp, Homo sapiens
  Payload ID: 5797
  Gene Symbol: FAM161A
  Gene Name: family with sequence similarity 161, member A
  ENST ID: ENST00000418113
  CDS Start-End: 1-1805
accgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggctcagcccgctggggcatcggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgtggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaaggagatcacttgaggaaaagaaaatgttggaagaagagagaaatcggatcctaactaaacagaagcaaagaatgaaagaattgcagaaactcctgacaacccgggctaaggcttatgactcacatcaaagtttagctcaaatatctaaatccagagtaaaatgtctcaggccaggcgcaatggctcatgcctgtaatcccagcactttgagaggccaagacaggcagatcacctgaggtcaggagttcaagaccagcctggccaacatggtgaaaccctcatctctactaaaaatacagaaaattagccaggcatggtggtgcacacctgtaatctcagctattcgggaagctgaggcacgagaattgcatgaacccaggaggtagaagttgcagtgagctgagattgtgccaccgcaccagcctgagcaacagaatgagactccatctcaaaacaaaaaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacattatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgtgagttataatctaaattaggggcaagtatccctttttttatatgatgaaattgtgcataataacttggctagggcaagtctccaaagtaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtg

SEQ ID NO: 132155 - DNA, 4078 bp, Homo sapiens
  Payload ID: 5798
  Gene Symbol: FAM161B
  Gene Name: family with sequence similarity 161, member B
  Uniprot ID: Q96MY7
  ENST ID: ENST00000286544
  CDS Start-End: 200-2332
accacctgcgccaggacaccagcgggccgctgtggggagctgcacgcacagccccgcatcggctgacaagccgggccgccatggtgcagacctgcgccgtcgcactcagaactcccgcaggcccacctacgtagtgcgtccggagcagagcactccaatcccgtcccgcttccgcggcgtcctcagaaccggaaataaaatgcgcggagaaaataggccaatcggaaaacgaaccttgcctcctcgggcgggatggatcggaggctgccctggaagccaaccagacgccaaagctagaaaggggtggaccctggccccgcatagctctcgctgccaccgctgctgccactatcgctgtcactgtcgctgctgcctctgtccagctgaaatgaccgtggggaggcctgagggagcccccggaggcgcggaggggagccgtcagatatttccccccgagtccttcgcagacacagaggcaggagaggagctgtccggggatgggctggttttgcccagggccagcaaacttgacgagttcctcagcccagaggaggagatagattctacttctgactcaactgggagcatttaccagaacttacaggaactgaagcagaaagggagatggtgtctgttggagtctctctttcagtctgacccagagagtgatgaaaacctctctgaagatgaggaggacctggagagtttcttccaagacaaggacagggggatggtgcaggtccagtgcccgcaggctctgaggtgtggctccacaaggcgctgcagctccctgaacaaccttccctccaacattcccaggcctcagacccagccaccctcaggctcccggcctccctcccagcacagaagcgtcagctcctgggcatcatccattactgtccctcggccattccgcatgacgctgcgcgaggcccggaagaaggccgagtggctgggctcacctgcctcctttgagcaggagaggcagcgggcccagaggcagggtgaggaagaggccgagtgccacaggcagttccgggcacagcctgtgcctgcacatgtctacctgcccctctaccaagagatcatggagcgcagcgaggcccgaaggcaggcagggatccagaagaggaaggaactgctcctctcttctttgaagcccttcagcttcctggagaaggaggagcagctaaaggaagctgctcgacagagagacttggcagccacagctgaagccaagatctccaagcagaaggccaccagaaggattcccaagtccattctggagccagcccttggggataaactccaggaagctgagctcttcaggaaaattcgcatccaaatgagagccctggacatgctccagatggcctcttcccctatcgcctcctctagtaaccgggctaacccacagccccgcacagccacccgaacccagcaggaaaagcttgggtttctgcacactaacttcagattccagcctcgggtgaatcctgtggtccctgactatgagggcctttacaaggccttccagagaagagcagccaaaagaagagaaacccaagaggccactcgcaacaagcccttcttgctgaggaccgccaacctgcgccaccctcagcggccctgtgatgctgccaccaccggaaggaggcaggattccccacagccaccagctacacccctgccaaggagtcgttctctgagcggccttgcttccctctctgccaacactctccctgtgcacatcacagatgccaccaggaagagggaatctgcagtcagaagtgcacttgaaaaaaagaacaaagcagatgagagtattcagtggctggagatacacaaaaagaagtctcaagcaatgtccaaatctgtgaccttgcgtgcaaaagccatggatccccataaaagcctggaggaagtgttcaaagcaaagctgaaagagaaccggaacaatgaccgtaaaagagcgaaagaatataagaaagaactggaggaaatgaagcagcgaatacaaacaaggccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccaggaaagtactggaggagctgtctcatcagtcaccagaaaatctcgtatcacttgcttaatcactacacttaaaattactgcttttgaaaaatattaagcagctaacttgggtttgagtcaaggcagggaaaacttgggttttgagtcatggctactgttagaggatggacaaatgaagagtagcagattaacaggccaggcgcagtggctcacgcctgtaatcccaacactttgggaggctgaggcaggcagatcatctgaggtcaggagtttgagaccagtccagccaacacggcaaaactccacctctactaaaaatacaaaaattagctgggcgtgatgacacgtgcctgtaatcctagctacttgggaagctgaggcaggagaatcacttgaacccaagaggcagaggttgtaatgagctgagatcactccacagcactccagcctgggcagcagagcaaaactctgtctgagaaaaaaaaagagcagcagataacagagaatagttcaaggaaatcaaagtggggaggctcaggtggagggatggtagcctaaagttaagggttcctgctttgtgcctcacacttagagaattaggtacagaaaagagagcacaggcccaaatgcctataaggggctagtgcagaaacataaatgcgtccatggagtgggtgtagacagtaggagatagtagacactggaaagtatcaaatcctgctggaatataggctcagagttactacatcaactacattttcatcaagccagaaatttgtatgctatcaactaatttaaaaattacttagaaatattgtatgggcaaaataaaatacatctgcatatcagatctagcccatgggggatgaaaaacttacaacttctagtacaggatttcttatcctcagtgctattaatattttgggccacctaattctttgttgagggttggggaagggaactgtcctgtacattgtagaatgtttagtagcatccctggccactacctgctagatgccagtagtacccctctccccagctgtgacaaccaaaaatgtctccagatattgcatatccccagggggcaaaaatgtgcctggctgagaaccactgctctaatataaatggctgcatgaagcaaaaactggcattctaagaatacaagtaattgccatgaacacagtctatgtactatgtgattatgcatgtcattaacaaattaagaatttaaaacaattctctcccgttatctgtttagaatgtgcctgtgtgtttatgtgagcatgaggttcattttaagtaaacttaaaatttcccagacaaccaagattttctactagtaggtgaactttggaataattttcttctcaccaataataattggatattctggctcggtgcagtggttcatgcttgtaatcccagcactttgaggggccaaggcaggaggatcgcttgaagccaggcgttcaagaccagcctgggcaacacagacctcatttctaccaaaaaaaccacaaaaagttagctggactggtggtacatgcctatagtcctagctattcaggaggctgaggtgggaggatgccttgagcgtaggagttcaaggttacattgagctatgattacactactgcactccagcctgggtgacagagcaagaccccatctcaaatcataatgatgatgagtggatattttctcagtagctgtggagacaggatgactgatagcaagagtgcctgctctaactaaagcacctttctcaagcttttttaaaaaaactatctttgtggaaaaattca

SEQ ID NO: 132156 - DNA, 1365 bp, Homo sapiens
  Payload ID: 5798
  Gene Symbol: FAM161B
  Gene Name: family with sequence similarity 161, member B
  ENST ID: ENST00000556794
  CDS Start-End: 1-433
gaacaaagcagatgagagtattcagtggctggagatacacaaaaagaagtctcaagcaatgtccaaatctgtgaccttgcgtgcaaaagccatggatccccataaaagcctggaggaagtgttcaaagcaaagctgaaagagaaccggaacaatgaccgtaaaagagcgaaagaatataagaaagaactggaggaaatgaagcagcgaatacaaacaaggccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccagatgcgtcttttttggtggtgacagagtaactatcacctgggcttaagaaatgaagatgttcttgttgtttcctaagactcctcggttcagttttactggtatggaatcctaagggtaaatcaatacactattttaaagggaaagattaaattcttaatctctaagaaaacaaattttgtataaaacaagagccaaagaactgactgggctgttttgtttatttaaaggaaaacctgaatctctgcatcatgtaatttttaactttaaaaaaacaaaaacatgaaatccctcttaacatgctactgtatgttccattaacgaagaaagcaaagtgaccaagtagaagtgtataggacaagatagtacctcagcctgggccaaggggagattcaagtaatttatttttttgcagcccagtggcagagagtctcttactcaggttgctaaagggagaatgtaacaagagaattgacatcactcccttcttcaaagcaacaaggcatcttgaaaactcaacttcctggtgaagctctgttgttggtagcaggaattatttcatccatgtgaaaagacagctgagtctgggatgaaaactcttcaaaggaaaacctcccctcaacagtcagaatgaagaacttcagccaacacataatcaaattcacttttggtctatcccagaaatttgcagtgggaagagaggtaggtacagtttcccagcccacagtcattgcttcattccttgtctgatcagatggtagttagaaaagaagctctcctacatccatcttctataccaggaaagaggaagagtggcaaaagcagagtcttgtgccttcaaagattcattctggttctgttgtgggctaaggcatcctgttcccagtatacgcattttgagatcagatagagttgctcttccaggagtcagcacccacgctcatgtccgtctttcagttaaatctccttggtttagtaact

SEQ ID NO: 132157 - DNA, 801 bp, Homo sapiens
  Payload ID: 5799
  Gene Symbol: FAM162A
  Gene Name: family with sequence similarity 162, member A
  ENST ID: ENST00000232125
  CDS Start-End: 281-715
cttcccactccaacgctgggtgacattgagctcaccagcgccaccgtccccggcgaagttctgcgctggtcggcggagtagcaagtggccatggggagcctcagcggtctgcgcctggcagcaggttggttcatgtgatcctggttaatggaacataagtgagattttatgggtgacagggagagagatcaggcttgacttgagagcacgtgggaaaagaagggggctatctcttcgcaaagatttaagtatcttataagaactgtttgccagtgcaattatgagaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatc

SEQ ID NO: 132158 - DNA, 3052 bp, Homo sapiens
  Payload ID: 5799
  Gene Symbol: FAM162A
  Gene Name: family with sequence similarity 162, member A
  Uniprot ID: Q96A26
  ENST ID: ENST00000477892
  CDS Start-End: 85-549
actccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagcgtcatggagttgcttggggtcaacacaagtcacctcttagcttcatgccttagaattctcaactggctgttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtggtttcagttacctgaggtctgaaaatattaaatggaaaattcctataacaatgcataagttatagattacataccattcagtgtagcatgatgaaatctcttgccaatctgttccatccacctgggatgtgaatcatccctctctctggtgtattcacactgtatgtgctagccgtctctgttacgagatcagctgtcgtggaatcagtgctagtgttcaggtaactcttatttaataattgcctcaaagtgcattgtgctgtgcctaatttataaaataaacggtatcataggtatgtatgtatacgaaaaacatagtatatgcagggttgggtactatccacagtttcaggcatctactggggggtcttggaatatatccccagagggtaaggggtgactactgtatacagccatgccaacatgctggttctcagagagttataagagagattaaaaatacatgcagctgtttgggcactttcttcccaaataaaatacccagtaaaatgtaacatactacctatagcttgataatctatctgaggatgtttatgatgtctgtctatatactttaatttggccttagcttctttgtaggtatcaagttatcacttgcaaatttattttcaaaaagcatagtttcttgtacattttagaagattagtttttcttattttgggacacctacaccaatgttttaaatgtggataaattttaatgtggaatttcttttaaaaataatcctcttcatagagcaatacaacaaaaatgtgttgtatcttggagatttacattataaatgtagtaacatttatgagcttaaatttaatgaaaccttttttttttttttgagacagtcttgcactgtcgcccaggctagagtgcagggcatgatctcagctcactgcaacctccgtctcccgggttcaagcaattctcgtgcctcagcctcctcagtaactggcattataggtgtgcaccaccacacctggctaatttttgtatttttcataaagacgggggtttcaccatgttggccaggctggtctcaaactcctgacctcaggtgatcagcctccctcggcctcccaaagtgctgggattacaggcatgagccatggtgcctggccaaacgtttttattacaaatattacattaaactaaagctcacaactgttattatgcatcaggaattaacagtcatttctcatttgtgttattctcctatttgataacatatagtgactatctctttatgggttaaatatcagtttcttggccagaattcaagatctgcccctaactaatcctacttctcccagtacccttacagcactcctaccctactagtaactctgatatctcatagtcctcagatttatcaagcaaacgaaactgaatgagcactactataaggtaccacaaactacaaaaggagacagttttgcccttgttgctttcagttaaattattgtgctattttttgcttaatttctaggttttttttgcgtgtttatcatgtctccgtaggtaaagtgggcagaaatctttttctactttacatttcctgtaagtgctgtttgtttgaataaagttaatgtgtgaggtta

SEQ ID NO: 132159 - DNA, 1015 bp, Homo sapiens
  Payload ID: 5799
  Gene Symbol: FAM162A
  Gene Name: family with sequence similarity 162, member A
  ENST ID: ENST00000469967
  CDS Start-End: 69-494
acattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggtgagaaggggtttcttctctatccagtatgtatgttctccaccaagaacctagagtaaatcagggattgacccttgtatttaccctctgagaagaggaggctactttctacattacatgagaaaagataagcaaaaaaataagacatattgggaacaagcctggaatatcatccttggggatagatagcaaatcctaactttggcgtggtgaagaaggactagattcattttgtgtaatgtaaatttaaaaagtgtttctgatgacaggtgtcataatgtaaattaagaaataggacactggcatatttaatcacccactgcatatttccagagtgctcttggtacccaagtgtatttaccctcaccataactgccttcagcatggtgagctttcttagcggggttctttatttgaagctcagccagacagggccatgtgtctaaggaccacagctcctaagcagtacataggaatacaagtccagaaatctttagcacagattataattaatagctatcactaattgaacactcactgcattccaggtacttttctagctggtatctcatctg

SEQ ID NO: 132160 - DNA, 1036 bp, Homo sapiens
  Payload ID: 5800
  Gene Symbol: FAM162B
  Gene Name: family with sequence similarity 162, member B
  Uniprot ID: Q5T6X4
  ENST ID: ENST00000368557
  CDS Start-End: 148-636
agctgagtgtgcgagcgccaggggttccagctgcacgtcccaggctctccagcgcgcggcaggccggggcgggacgaggagagctgcggggacaacgcctgtggctgggtccggaggtgcgggtgcggcgcgggacaagcgggcagcatgctcagggcggtcgggagcctactgcgccttggccgcgggctaacagtccgctgcggccccggggcgcctctcgaggccacgcgacggcccgcaccggctcttccgccccggggtctcccctgctactccagcggcggggcccccagcaattctgggccccaaggtcacggggagattcaccgagtccccacgcagcgcaggccttcgcagttcgacaagaaaatcctgctgtggacagggcgtttcaaatcgatggaggagatcccgcctcggatcccgccagaaatgatagacaccgcaagaaacaaagctcgagtgaaagcttgttacataatgattggactcacaattatcgcctgctttgctgtgatagtgtcagccaaaagggctgtagaacgacatgaatccttaacaagttggaacttggcaaagaaagctaagtggcgtgaagaagctgcattggctgcacaggctaaagctaaatgatattctaagtgacaaagtgttcacctgaataccatccctgtcatcagcaacagtagaagatgggaaaaatagaatatttaccaaaatatctgccatggttttattttggtaacaagaagcacaatgtcttttttatttttattttttagtaaacttttactgaagtataccatgcattcaaaaagtggacaaaactgtatacagtctgatagatatttatgtcgtgaacacctgtgtaaccactgccaaagtgaagatgtagaatattggcaacacttcacagcctcattcctgccttttctcagccattacctcccaaacatagcagtttttctgagtttcatcacctttgattcattttgcctgtttttgaactttatataaatggatttatacatta

SEQ ID NO: 132161 - DNA, 2909 bp, Homo sapiens
  Payload ID: 5801
  Gene Symbol: FAM163A
  Gene Name: family with sequence similarity 163, member A
  Uniprot ID: Q96GL9
  ENST ID: ENST00000341785
  CDS Start-End: 397-900
cgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcgggactgatgcccttggccagacgcacccccaactgctgtctgctcaggtgtagcccgcgtgactgagtcaccgctgctccagctgtttcacgtcgccgttccctttactgaatagtttgatggggcgccgggcggatgacagcgggaacggttgtgatcactggcggaatcctagctacggtgatcctcctctgcatcattgccgtcctgtgctactgcaggctccagtattactgctgcaagaagagcggaaccgaggttgcagacgaggaggaggagcgggagcacgaccttcccacgcatcccagaggccccacctgcaatgcctgcagctcccaagccctggacggcagaggcagcctggcgcctctcaccagcgagccctgcagccagccctgtggggtggccgcgagccactgcactacctgctccccatacagctcccccttttacatacggacggctgacatggtgcccaatgggggtggaggcgagaggctctcctttgctcccacatactacaaagaggggggacccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaa

SEQ ID NO: 132162 - DNA, 1131 bp, Homo sapiens
  Payload ID: 5802
  Gene Symbol: FAM163B
  Gene Name: family with sequence similarity 163, member B
  Uniprot ID: P0C2L3
  ENST ID: ENST00000356873
  CDS Start-End: 24-524
gctgttgatggagaagggggcggatgacagccgggaccgtggtcatcaccgggggcatcttggcgactgtgattttgctctgcatcatcgctgttctgtgctactgccggctccagtactactgctgcaagaaggacgagtcggaggaggacgaggaggaaccagacttcgccgttcactcgcacctgcccccgctgcactccaaccgcaacctggtgctgaccaacgggccggcgctctaccccaccgcctccacctccttcagccagaagtccccgcaggcccgcgccctctgccgcagctgctcccactgcgagccccccaccttcttcctgcaggagccgccggaggaggaagaggacgtgctgaacggcggggagcgcgtgctctacaagagcgtgagccaggaggacgtggagctgcccccggggggcttcgggggcctgcaggcgctcaaccccaaccgcctctcagccatgcgggaggccttcgccaggagccgcagcatcagcaccgacgtgtgacctgggcccgcccccgggatcctggccttgaaggtcctgagacaatggggggattcctttggcacacccacctggccccaggccccaagtggggcttggctgagccctcctggaatccctgtcctcaggggaggcccaggcttggggagcccccaggctcgtggcagggataaggctcattgaacacaaatgtgtcctggggggaggcacagctggggcctggggctagaaggaccaggtgaccatacagccggctgggcatgcaccagggctctcaggcacagaggccaccgttactcctgatgattctgtctcagacccaacaacctggccttcccaggaggtctccatgtgtcaccccctccctgggtctcacccttctcacctgctcaaggaagggatgacctcagtgaggcccagggccctgcagcaaggccctccctggcaattgcagaccaaggattctgctcctccaccttgaactccagcctctttctctccatttttccctctctctcccctacccgtctctccctctctctcacacacacactcttccgggttcaagggccaagtgtctgcctaggctgagacacgtgctgagctc

SEQ ID NO: 132163 - DNA, 811 bp, Homo sapiens
  Payload ID: 5802
  Gene Symbol: FAM163B
  Gene Name: family with sequence similarity 163, member B
  Uniprot ID: P0C2L3
  ENST ID: ENST00000496132
  CDS Start-End: 246-746
cccttctgccagcccacccccagccgggctctggataacatctcggagaccaaccgcggcagcacagggcagccgagcacttcctcgtctgtttattactgaacgcaggcatctgggagcccgcggagcatgaaattaggaacaaatgtgcaggaggtctagacaggaactctgcgggctgctctcctccgatcgaggacgccggggcccttgggcttccaggctgttgatggagaagggggcggatgacagccgggaccgtggtcatcaccgggggcatcttggcgactgtgattttgctctgcatcatcgctgttctgtgctactgccggctccagtactactgctgcaagaaggacgagtcggaggaggacgaggaggaaccagacttcgccgttcactcgcacctgcccccgctgcactccaaccgcaacctggtgctgaccaacgggccggcgctctaccccaccgcctccacctccttcagccagaagtccccgcaggcccgcgccctctgccgcagctgctcccactgcgagccccccaccttcttcctgcaggagccgccggaggaggaagaggacgtgctgaacggcggggagcgcgtgctctacaagagcgtgagccaggaggacgtggagctgcccccggggggcttcgggggcctgcaggcgctcaaccccaaccgcctctcagccatgcgggaggccttcgccaggagccgcagcatcagcaccgacgtgtgacctgggcccgcccccgggatcctggccttgaaggtcctgagacaatggggggattcctttggcac

SEQ ID NO: 132164 - DNA, 1124 bp, Homo sapiens
  Payload ID: 5803
  Gene Symbol: FAM166A
  Gene Name: family with sequence similarity 166, member A
  Uniprot ID: Q6J272
  ENST ID: ENST00000344774
  CDS Start-End: 56-1009
aagggagctggatgccgggagggactggagccagcaaggccagagtgaaagcaaaatgacaactactcagaaacacgatctcttcacgccggagcctcactatgtccctggctatgccggcttctttccgcagctgcgctaccaggtggggaacacctatgggcgtaccacggggcagctgctcacagaccccagtgtgcagaagagcccctgctctgtgctgtcccccatgtccaaacccaagttcattgaggacttcagccagtccaagcccccgagggttccctgccaagacctgacggagccctacatcccccactacaccagtctgaagccctctaagaactttgagattctgggccagctcccacccttggaggtggacgcccaggagccgccaggggtagagaacatacccagacagattctgctgcctgcaggcttcacgcccgacaccccgcaccctccgtgcccaccaggcaggaagggagactccagagacttgggacacccagtatacggggaagaggcctggaagagcgccactcctgtttgcgaggcccccaggcagcaccagctgtaccactgccagagggatgagtacccaccccccgcccgccgccagcaggagacgctagatgtgggcagcttccagcggctgccgcagctggaccaccctaacctaatccaacgcaaggccatctcaggctatgctggcttcattccccgtttcacctgggtaatggggttgaattaccgagacggcgtcatgcaagccatggacgaattcgacaagagccagttcctgtttagaaacccccactgtgacctgggcgagaagctgcctggaacacactggcccagcaaccacatctacagcagccaaggcctgatccccttctacatggggttcatccccgccatgcaggacaactacgccctgacattcggcaacagcacccggagggcctactggaaggaatgggcaaagcgaaaccacacactatgaaaatgctttaatggtggtgtctgtacagcatggatgtggacagggaaaacagcaagtgcacacagtgggacaggccacaggacaggctgggagtgaataaagagttcacactgct

SEQ ID NO: 132165 - DNA, 705 bp, Homo sapiens
  Payload ID: 5803
  Gene Symbol: FAM166A
  Gene Name: family with sequence similarity 166, member A
  ENST ID: ENST00000484720
  CDS Start-End: 36-705
gggactggagccagcaaggccagagtgaaagcaaaatgacaactactcagaaacacgatctcttcacgccggagcctcactatgtccctggctatgccggcttctttccgcagctgcgctaccaggtggggaacacctatgggcgtaccacggggcagctgctcacagaccccagtgtgcagaagagcccctgctctgtgctgtcccccatgtccaaacccaagttcattgaggacttcagccagtccaagcccccgagggttccctgccaagacctgacggagccctacatcccccactacaccagtgagctgccagtccccagccctgcaccctcctgtgcccgcctgcctgtcccggcactcacaggctgccctgttggtacaggtctgaagccctctaagaactttgagattctgggccagctcccacccttggaggtggacgcccaggagccgccaggggtagagaacatacccagacagattctgctgcctgcaggcttcacgcccgacaccccgcaccctccgtgcccaccaggcaggaagggagactccagagacttgggacacccagtatacggggaagaggcctggaagagcgccactcctgtttgcgaggcccccaggcagcaccagctgtaccactgccagagggatgagtacccaccccccgcccgccgccagcaggagacgctagatgtgg

SEQ ID NO: 132166 - DNA, 958 bp, Homo sapiens
  Payload ID: 5804
  Gene Symbol: FAM166B
  Gene Name: family with sequence similarity 166, member B
  Uniprot ID: A8MTA8
  ENST ID: ENST00000399742
  CDS Start-End: 72-899
agccctggacacggtacacacagaccagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagg

SEQ ID NO: 132167 - DNA, 889 bp, Homo sapiens
  Payload ID: 5804
  Gene Symbol: FAM166B
  Gene Name: family with sequence similarity 166, member B
  Uniprot ID: A8MTA8
  ENST ID: ENST00000447837
  CDS Start-End: 72-722
agccctggacacggtacacacagaccagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaag

SEQ ID NO: 132168 - DNA, 1026 bp, Homo sapiens
  Payload ID: 5804
  Gene Symbol: FAM166B
  Gene Name: family with sequence similarity 166, member B
  ENST ID: ENST00000619051
  CDS Start-End: 72-851
agccctggacacggtacacacagaccagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcagctttcctgtgctcaccaaccaggcactgcaggaatttgggcagaagcactcaccaggcagtgcccaggaccccaaacatctccccccacttcccagaacataccctcagaacctgggtcttttacaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacag

SEQ ID NO: 132169 - DNA, 4094 bp, Homo sapiens
  Payload ID: 5805
  Gene Symbol: FAM167A
  Gene Name: family with sequence similarity 167, member A
  Uniprot ID: Q96KS9
  ENST ID: ENST00000284486
  CDS Start-End: 540-1184
aaaggagcagcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactataaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaaaaatg

SEQ ID NO: 132170 - DNA, 1120 bp, Homo sapiens
  Payload ID: 5805
  Gene Symbol: FAM167A
  Gene Name: family with sequence similarity 167, member A
  ENST ID: ENST00000531804
  CDS Start-End: 847-1120
gtgagaatggcagactggagccctttgaaagacgcttccagccccgggcatctaggaaaggtgcttgatgaggtctgggatgaagaaaatgagacttagcaagcctgacaagacgtagagctaggccatctgatcccaactctagtgtctgcatctggagacagtggttctccaccccggctgcacactcggatcatcgggggagctgaacactgctgtctaagtcccatctctcgaccaattgaatcagaatccagttcctcagggggattctcgcttgctccaagcagagctggaggtgctgccatgcgggcacttaggtgaacacgagaagcctcgttctagaacaatgagtcacagcctgcttgtttagccatccagcccaggtgccaccgccttcttccctccacagctgcaggtttatttgcttctgtctctgaagaggtgagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcacc

SEQ ID NO: 132171 - DNA, 1642 bp, Homo sapiens
  Payload ID: 5805
  Gene Symbol: FAM167A
  Gene Name: family with sequence similarity 167, member A
  Uniprot ID: Q96KS9
  ENST ID: ENST00000534308
  CDS Start-End: 476-1120
ctcctgtggagtggacgtgcccgcctctgagtggcagggcagggatcgggactgatgcggttctcatccctcccacagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaa

SEQ ID NO: 132172 - DNA, 1620 bp, Homo sapiens
  Payload ID: 5805
  Gene Symbol: FAM167A
  Gene Name: family with sequence similarity 167, member A
  Uniprot ID: Q96KS9
  ENST ID: ENST00000528897
  CDS Start-End: 621-1265
gatgtagaaacggctgctggaggacaggacctgtggtgggtggaggtggtgagggggcagtggcacctggacggagcagacccaccttagcctgtgtggggtgcggtttccctgctggctggctctggggaccccccggctgttgccacagagaggaaagacctgtggcctcagattcagacagcctgagcttgtccccacaacttattgctgggagatctcgggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggc

SEQ ID NO: 132173 - DNA, 936 bp, Homo sapiens
  Payload ID: 5806
  Gene Symbol: FAM167B
  Gene Name: family with sequence similarity 167, member B
  Uniprot ID: Q9BTA0
  ENST ID: ENST00000373582
  CDS Start-End: 190-681
cacacacccatctgctcactcaccctggcacattcagcccccctaacccaccttgaacattgaccaccacacactccctggcacgctcttctcaccctcaacttctgccacctctccctgggcaatactgccagcctttccctaatctcagagctgcagccctgccctgtcactcacctcaaacctgccatgtccctggggctactgaaattccaggcagtgggtgaagaggacgaggaggatgaggagggggagagcctggactctgtgaaggcactgacagccaagctgcagctgcagactcggcggccctcatatctggagtggacagcccaggtccagagccaggcctggcgcagggcccaagccaaacctggaccagggggacctggggacatctgtggtttcgactcaatggactccgcccttgagtggctccgacgggagctgcgggagatgcaggcgcaggacaggcagctggcagggcagctgctgcggctgcgggcccagctgcaccgactgaagatggaccaagcctgtcacctgcaccaggagctgctggatgaggccgagctggagctggagctggagcccggggccggcctagccctggccccgctgctgcggcacctgggcctcacgcgcatgaacatcagcgcccggcgcttcaccctctgctgaggaacacctgtgccccccgactccccgccccctctcccaatgccgcttcccctgcctgcctgggaagaggaaagggaggggtgccccagaggcaccagctcctggcgggggaggaggaacattcaggtttctgagagctgaattccaagagtgcaaaaccccagcatcctgtttcctctgctgacccagctgggagggggaggaggaggagctcacaccctcaaactcctcaataaacgctttctctggttccca

SEQ ID NO: 132174 - DNA, 7296 bp, Homo sapiens
  Payload ID: 5807
  Gene Symbol: FAM168A
  Gene Name: family with sequence similarity 168, member A
  Uniprot ID: Q92567
  ENST ID: ENST00000064778
  CDS Start-End: 286-1020
ccttctgagcggtcccccgcctcctccctccgcctcctcctccctcgcccgcagccgagcgtcccctccccccacccgtcgggctcctcggcggctactgcagaggattcagagccgagtcgctgaggaggaggctccggtccccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagagtttcagttcctgcattcagcttatgcaactctgctgatgaaacaggcctggccacagaactcgtcttcctgtggcactgaaggcaccttccacctcccagtggacaccgggaccgagaaccgaacttaccaagcatcctctgcggctttcagatatactgcggggacaccatacaaggtcccaccgacccagagtaacactgctccacccccctactccccatcacccaacccctatcagacggccatgtatccaatcagaagtgcctacccccagcagaatctgtatgcccagggagcctactacacacagccggtgtatgctgcccagcctcatgtcatccaccataccacggtcgtccagcccaacagcattccctctgctatctacccagcacctgttgccgccccgaggaccaacggtgtggccatgggcatggtggcaggcaccaccatggcaatgtcagcaggtaccctgctgactacaccccagcacacggcgattggggcacaccctgtctccatgccaacatatagggcccaaggaacccctgcgtacagctacgtgcccccacactggtaaagcctgcagcccatccaaatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgctaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattcccccccaaaaaaaagtcttaggtgactagactgagtggttcttggggagggaggcacagaggactgtcctgggccagtgagtcccttgggcgtctccccaagttgatgctaaatttgttctcagtagtcaagaaaaacctatggtacatcttacagctgatctgacaggggtctgccctaagggtctcacagctgctggggagctttaagtggcaacttcagcacccaccctaagtgtgtgatgtgggagcacagtgaggccattcagagttgaaatccattgagccatccgcgcaataaagctgacatctattgtgtg

SEQ ID NO: 132175 - DNA, 1767 bp, Homo sapiens
  Payload ID: 5807
  Gene Symbol: FAM168A
  Gene Name: family with sequence similarity 168, member A
  Uniprot ID: Q92567
  ENST ID: ENST00000356467
  CDS Start-End: 280-987
gagcggtcccccgcctcctccctccgcctcctcctccctcgcccgcagccgagcgtcccctccccccacccgtcgggctcctcggcggctactgcagaggattcagagccgagtcgctgaggaggaggctccggtccccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagcaactctgctgatgaaacaggcctggccacagaactcgtcttcctgtggcactgaaggcaccttccacctcccagtggacaccgggaccgagaaccgaacttaccaagcatcctctgcggctttcagatatactgcggggacaccatacaaggtcccaccgacccagagtaacactgctccacccccctactccccatcacccaacccctatcagacggccatgtatccaatcagaagtgcctacccccagcagaatctgtatgcccagggagcctactacacacagccggtgtatgctgcccagcctcatgtcatccaccataccacggtcgtccagcccaacagcattccctctgctatctacccagcacctgttgccgccccgaggaccaacggtgtggccatgggcatggtggcaggcaccaccatggcaatgtcagcaggtaccctgctgactacaccccagcacacggcgattggggcacaccctgtctccatgccaacatatagggcccaaggaacccctgcgtacagctacgtgcccccacactggtaaagcctgcagcccatccaaatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactga

SEQ ID NO: 132176 - DNA, 1364 bp, Homo sapiens
  Payload ID: 5807
  Gene Symbol: FAM168A
  Gene Name: family with sequence similarity 168, member A
  Uniprot ID: Q92567
  ENST ID: ENST00000450446
  CDS Start-End: 195-584
cggctactgcagaggattcagagccgagtcgctgaggaggaggctccggtccccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagcaactctgctgatgaaacaggcctggccacagaactcgtcttcctgtggcactgaaggcaccttccacctcccagtggacaccgggaccgagaaccgaacttaccaagcatcctctgcggctttcagtaccctgctgactacaccccagcacacggcgattggggcacaccctgtctccatgccaacatatagggcccaaggaacccctgcgtacagctacgtgcccccacactggtaaagcctgcagcccatccaaatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactga

SEQ ID NO: 132177 - DNA, 944 bp, Homo sapiens
  Payload ID: 5808
  Gene Symbol: FAM168B
  Gene Name: family with sequence similarity 168, member B
  Uniprot ID: A1KXE4
  ENST ID: ENST00000389915
  CDS Start-End: 259-846
gtcggcggctccggtggctgcgcagcgtcggcggggagcgcgggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcgtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttc

SEQ ID NO: 132178 - DNA, 5285 bp, Homo sapiens
  Payload ID: 5808
  Gene Symbol: FAM168B
  Gene Name: family with sequence similarity 168, member B
  Uniprot ID: A1KXE4
  ENST ID: ENST00000409185
  CDS Start-End: 109-696
ggggagcgcgggctgcggagaggcgggccgggccaagcggagccgagcgagcgggagcgcggcgtccgggaggcggcggagacgcggggctcggaggtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 132179 - DNA, 5990 bp, Homo sapiens
  Payload ID: 5809
  Gene Symbol: FAM169A
  Gene Name: family with sequence similarity 169, member A
  Uniprot ID: Q9Y6X4
  ENST ID: ENST00000389156
  CDS Start-End: 92-2104
atggccgcgcccactctgggtaaatttcaggagggcctacgcggggctggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaaaaagtatgactactattagtgaatctaccaaacatttatgctgttttatacattttatgagaaacttctgtcaatatcacaaagggaaatactctgttaagattcagtaaattcttaatctttacatgtttcatttcttagatttgaaaacacttgtagatattttatttttacttggatttgtttaaaatactttcttttcaaattattttaaacatggaaacgcttcatgaatttgtgtcatccttgcacaggggccatgctaattttccctgtattgttctaattttagtatatgtgctgccgaagtgagcactaaaagactttctttagacaagtgtagttttttaaagattgagctcactggctcaactcttgatgtgtgaatatagttgagtttacaaaaaatgtttattaatcatatatgaccattgggggctaacagtataaacttattcttgttaaacttgtttgggttaaatagtaagtgaattgtaaacaatttagaagttttttgttcagcacacaagaacacttctgttacagattctctctgacagaaattgttattttggggtttatagattatagagggaaaagttagatcacttggaaaaacctaactctcatgttcagtaacttgagtatagaatttataccacaatttatcttcaataaggaacctacatgaacttaatcagttatctgtagtttttgcaaggcattagaaaaaatttcacaattacagaggactgaaaatgtgatttcaaccggctagtctagttgttgaatgtccagtcacattacacatagtcctttgtgaacttatttgtgaagggagttcactttttatgtacatacgtgtatatttccttgtgtaatataaagcagatggttattagtattttagttctttcaagtttaaattattcaattgctagacatcacagaaattagtatatttaagaatttattataaagctcctctacaacttttaaaggtgagagggtctattatgatttttttataaaatcaaacagcatgatttagaacgtcagtcttctacttaaaatgtgtctatattcatggtatttccattcagtgtagatggtaaggaaaacatctagtcattaaagatttacttatagcagactccagaacactacctacaatggggtttcagtgactagaaatcttgaaggtttatgattgcatcaaattgagcctgtactaatatctaaatatctgctcttatgttctgctttatcccttgggattaccttctaaggtttggtcacaccagcaaactgaaacagatcttaatgtacataaaaaatttatactaatattactcatctgtgttacagtattttgaaaaatgtttcaggtgtcatctagtcgtctttcatgggtgtgattagttacaaatgttatgcttatgttttcatacttaatatcaagctttctttgtaccttacaagatagtatttttggttctaaaaaaaacaagcaaacttcatttttgtagtatccagaaattacctggagtcagtatttttattcgccttctagaacttgtgatccacacatcacccatttatattagtggtaaaattatctgctaaaatctaattgtaagaaaggcttaccttctgtcatcaagtgattgtatcatcctggatcgtcatttccaaggaactagcctttcttttcctaagcgtctgtatgtgttctaaaacttccagtatatatttatagaacttagaaaaaatgttacattattcagagtagcaagtcttactggagtacctatgtttgttttcttggtttttatttttttttaagtttaaaagtagtaattaaacctatattttgtgattgtttcctggtctgtgtttttaaattcctttccttcagttttcctcatgaagatgtttcagatactgaatttgtttagacattgaatgactttgttaaaggcacaattaatcacattggttgtactctgaagacagacttctttaaaaaaaaaataaacaatttaaaacaa

SEQ ID NO: 132180 - DNA, 571 bp, Homo sapiens
  Payload ID: 5809
  Gene Symbol: FAM169A
  Gene Name: family with sequence similarity 169, member A
  ENST ID: ENST00000506954
  CDS Start-End: 314-571
attctccctcctctggaatgctggtcgttgcagttttgtcctaattgtgttctcagctctccattatgccatttttcaagaggcctgtgcctcaggaggtgaagccttgaaccctgggtggtttatggctcgggggtctggattacactgactcccatgactgtccttggggagaaaggatgaagcatctcactggcttttcagcgtctgggaagcggcgtgggtatcgtatcgggtggattcgaagataaccacctgatgcaggtcaccttcccccgctgggagagccgttcctaacgtaaattaaaacaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcag

SEQ ID NO: 132181 - DNA, 803 bp, Homo sapiens
  Payload ID: 5809
  Gene Symbol: FAM169A
  Gene Name: family with sequence similarity 169, member A
  ENST ID: ENST00000513277
  CDS Start-End: 136-803
cccacgattctaacttgcatgcacctaagtggcagtaggtttaggatgaaagtggtggggcggaggccggcggtcctcgcccgtgccctctgcacccctgtcccgaggccgggatggccgcgcccactctggaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatac

SEQ ID NO: 132182 - DNA, 751 bp, Homo sapiens
  Payload ID: 5809
  Gene Symbol: FAM169A
  Gene Name: family with sequence similarity 169, member A
  ENST ID: ENST00000514200
  CDS Start-End: 227-751
agtgcgtcacgtcgtcggagggcacggtgggccgcggccgacccgcgacgaggagccgggcgtccggggcgagcgggaggcagccgcactcgccctggcagccgcgagctgtgcggcctgggaccggccggaggtcgccagcgagcagccgccggctccattcattcgcgcggctccgcctcctttcccgggctcttccagcggctcccggggcgcgtctgagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttac

SEQ ID NO: 132183 - DNA, 5908 bp, Homo sapiens
  Payload ID: 5809
  Gene Symbol: FAM169A
  Gene Name: family with sequence similarity 169, member A
  Uniprot ID: Q9Y6X4
  ENST ID: ENST00000510609
  CDS Start-End: 184-567
cgcgacgaggagccgggcgtccggggcgagcgggaggcagccgcactcgccctggcagccgcgagctgtgcggcctgggaccggccggaggtcgccagcgagcagccgccggctccattcattcgcgcggctccgcctcctttcccgggctcttccagcggctcccggggcgcgtctgagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaaaaagtatgactactattagtgaatctaccaaacatttatgctgttttatacattttatgagaaacttctgtcaatatcacaaagggaaatactctgttaagattcagtaaattcttaatctttacatgtttcatttcttagatttgaaaacacttgtagatattttatttttacttggatttgtttaaaatactttcttttcaaattattttaaacatggaaacgcttcatgaatttgtgtcatccttgcacaggggccatgctaattttccctgtattgttctaattttagtatatgtgctgccgaagtgagcactaaaagactttctttagacaagtgtagttttttaaagattgagctcactggctcaactcttgatgtgtgaatatagttgagtttacaaaaaatgtttattaatcatatatgaccattgggggctaacagtataaacttattcttgttaaacttgtttgggttaaatagtaagtgaattgtaaacaatttagaagttttttgttcagcacacaagaacacttctgttacagattctctctgacagaaattgttattttggggtttatagattatagagggaaaagttagatcacttggaaaaacctaactctcatgttcagtaacttgagtatagaatttataccacaatttatcttcaataaggaacctacatgaacttaatcagttatctgtagtttttgcaaggcattagaaaaaatttcacaattacagaggactgaaaatgtgatttcaaccggctagtctagttgttgaatgtccagtcacattacacatagtcctttgtgaacttatttgtgaagggagttcactttttatgtacatacgtgtatatttccttgtgtaatataaagcagatggttattagtattttagttctttcaagtttaaattattcaattgctagacatcacagaaattagtatatttaagaatttattataaagctcctctacaacttttaaaggtgagagggtctattatgatttttttataaaatcaaacagcatgatttagaacgtcagtcttctacttaaaatgtgtctatattcatggtatttccattcagtgtagatggtaaggaaaacatctagtcattaaagatttacttatagcagactccagaacactacctacaatggggtttcagtgactagaaatcttgaaggtttatgattgcatcaaattgagcctgtactaatatctaaatatctgctcttatgttctgctttatcccttgggattaccttctaaggtttggtcacaccagcaaactgaaacagatcttaatgtacataaaaaatttatactaatattactcatctgtgttacagtattttgaaaaatgtttcaggtgtcatctagtcgtctttcatgggtgtgattagttacaaatgttatgcttatgttttcatacttaatatcaagctttctttgtaccttacaagatagtatttttggttctaaaaaaaacaagcaaacttcatttttgtagtatccagaaattacctggagtcagtatttttattcgccttctagaacttgtgatccacacatcacccatttatattagtggtaaaattatctgctaaaatctaattgtaagaaaggcttaccttctgtcatcaagtgattgtatcatcctggatcgtcatttccaaggaactagcctttcttttcctaagcgtctgtatgtgttctaaaacttccagtatatatttatagaacttagaaaaaatgttacattattcagagtagcaagtcttactggagtacctatgtttgttttcttggtttttatttttttttaagtttaaaagtagtaattaaacctatattttgtgattgtttcctggtctgtgtttttaaattcctttccttcagttttcctcatgaagatgtttcagatactgaatttgtttagacattgaatgactttgttaaaggcacaattaatcacattggttgtactctgaagacagacttctttaaaaaaaaaataaacaatttaaaac

SEQ ID NO: 132184 - DNA, 5810 bp, Homo sapiens
  Payload ID: 5809
  Gene Symbol: FAM169A
  Gene Name: family with sequence similarity 169, member A
  ENST ID: ENST00000510496
  CDS Start-End: 92-1924
atggccgcgcccactctgggtaaatttcaggagggcctacgcggggctggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaaaaagtatgactactattagtgaatctaccaaacatttatgctgttttatacattttatgagaaacttctgtcaatatcacaaagggaaatactctgttaagattcagtaaattcttaatctttacatgtttcatttcttagatttgaaaacacttgtagatattttatttttacttggatttgtttaaaatactttcttttcaaattattttaaacatggaaacgcttcatgaatttgtgtcatccttgcacaggggccatgctaattttccctgtattgttctaattttagtatatgtgctgccgaagtgagcactaaaagactttctttagacaagtgtagttttttaaagattgagctcactggctcaactcttgatgtgtgaatatagttgagtttacaaaaaatgtttattaatcatatatgaccattgggggctaacagtataaacttattcttgttaaacttgtttgggttaaatagtaagtgaattgtaaacaatttagaagttttttgttcagcacacaagaacacttctgttacagattctctctgacagaaattgttattttggggtttatagattatagagggaaaagttagatcacttggaaaaacctaactctcatgttcagtaacttgagtatagaatttataccacaatttatcttcaataaggaacctacatgaacttaatcagttatctgtagtttttgcaaggcattagaaaaaatttcacaattacagaggactgaaaatgtgatttcaaccggctagtctagttgttgaatgtccagtcacattacacatagtcctttgtgaacttatttgtgaagggagttcactttttatgtacatacgtgtatatttccttgtgtaatataaagcagatggttattagtattttagttctttcaagtttaaattattcaattgctagacatcacagaaattagtatatttaagaatttattataaagctcctctacaacttttaaaggtgagagggtctattatgatttttttataaaatcaaacagcatgatttagaacgtcagtcttctacttaaaatgtgtctatattcatggtatttccattcagtgtagatggtaaggaaaacatctagtcattaaagatttacttatagcagactccagaacactacctacaatggggtttcagtgactagaaatcttgaaggtttatgattgcatcaaattgagcctgtactaatatctaaatatctgctcttatgttctgctttatcccttgggattaccttctaaggtttggtcacaccagcaaactgaaacagatcttaatgtacataaaaaatttatactaatattactcatctgtgttacagtattttgaaaaatgtttcaggtgtcatctagtcgtctttcatgggtgtgattagttacaaatgttatgcttatgttttcatacttaatatcaagctttctttgtaccttacaagatagtatttttggttctaaaaaaaacaagcaaacttcatttttgtagtatccagaaattacctggagtcagtatttttattcgccttctagaacttgtgatccacacatcacccatttatattagtggtaaaattatctgctaaaatctaattgtaagaaaggcttaccttctgtcatcaagtgattgtatcatcctggatcgtcatttccaaggaactagcctttcttttcctaagcgtctgtatgtgttctaaaacttccagtatatatttatagaacttagaaaaaatgttacattattcagagtagcaagtcttactggagtacctatgtttgttttcttggtttttatttttttttaagtttaaaagtagtaattaaacctatattttgtgattgtttcctggtctgtgtttttaaattcctttccttcagttttcctcatgaagatgtttcagatactgaatttgtttagacattgaatgactttgttaaaggcacaattaatcacattggttgtactctgaagacagacttctttaaaaaaaaaataaacaatttaaaacaa

SEQ ID NO: 132185 - DNA, 5954 bp, Homo sapiens
  Payload ID: 5809
  Gene Symbol: FAM169A
  Gene Name: family with sequence similarity 169, member A
  Uniprot ID: Q9Y6X4
  ENST ID: ENST00000514215
  CDS Start-End: 228-611
tagcaacctatatttctctctggaactttaccacccttccgctgcctctctaaactatagtagcagaaccactgttaggcttgcaatttacatagtcttaaattaaccaagactcaaaaacaaacaaaaaaaacaattccaagcatttagaggtgaaaaggtctttaggattatcctgtccagttgcatcacgttaccaatgagagtacagaagcctaaagaggaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaaaaagtatgactactattagtgaatctaccaaacatttatgctgttttatacattttatgagaaacttctgtcaatatcacaaagggaaatactctgttaagattcagtaaattcttaatctttacatgtttcatttcttagatttgaaaacacttgtagatattttatttttacttggatttgtttaaaatactttcttttcaaattattttaaacatggaaacgcttcatgaatttgtgtcatccttgcacaggggccatgctaattttccctgtattgttctaattttagtatatgtgctgccgaagtgagcactaaaagactttctttagacaagtgtagttttttaaagattgagctcactggctcaactcttgatgtgtgaatatagttgagtttacaaaaaatgtttattaatcatatatgaccattgggggctaacagtataaacttattcttgttaaacttgtttgggttaaatagtaagtgaattgtaaacaatttagaagttttttgttcagcacacaagaacacttctgttacagattctctctgacagaaattgttattttggggtttatagattatagagggaaaagttagatcacttggaaaaacctaactctcatgttcagtaacttgagtatagaatttataccacaatttatcttcaataaggaacctacatgaacttaatcagttatctgtagtttttgcaaggcattagaaaaaatttcacaattacagaggactgaaaatgtgatttcaaccggctagtctagttgttgaatgtccagtcacattacacatagtcctttgtgaacttatttgtgaagggagttcactttttatgtacatacgtgtatatttccttgtgtaatataaagcagatggttattagtattttagttctttcaagtttaaattattcaattgctagacatcacagaaattagtatatttaagaatttattataaagctcctctacaacttttaaaggtgagagggtctattatgatttttttataaaatcaaacagcatgatttagaacgtcagtcttctacttaaaatgtgtctatattcatggtatttccattcagtgtagatggtaaggaaaacatctagtcattaaagatttacttatagcagactccagaacactacctacaatggggtttcagtgactagaaatcttgaaggtttatgattgcatcaaattgagcctgtactaatatctaaatatctgctcttatgttctgctttatcccttgggattaccttctaaggtttggtcacaccagcaaactgaaacagatcttaatgtacataaaaaatttatactaatattactcatctgtgttacagtattttgaaaaatgtttcaggtgtcatctagtcgtctttcatgggtgtgattagttacaaatgttatgcttatgttttcatacttaatatcaagctttctttgtaccttacaagatagtatttttggttctaaaaaaaacaagcaaacttcatttttgtagtatccagaaattacctggagtcagtatttttattcgccttctagaacttgtgatccacacatcacccatttatattagtggtaaaattatctgctaaaatctaattgtaagaaaggcttaccttctgtcatcaagtgattgtatcatcctggatcgtcatttccaaggaactagcctttcttttcctaagcgtctgtatgtgttctaaaacttccagtatatatttatagaacttagaaaaaatgttacattattcagagtagcaagtcttactggagtacctatgtttgttttcttggtttttatttttttttaagtttaaaagtagtaattaaacctatattttgtgattgtttcctggtctgtgtttttaaattcctttccttcagttttcctcatgaagatgtttcagatactgaatttgtttagacattgaatgactttgttaaaggcacaattaatcacattggttgtactctgaagacagacttctttaaaaaaaaaataaacaatttaaaacaa

SEQ ID NO: 132186 - DNA, 576 bp, Homo sapiens
  Payload ID: 5810
  Gene Symbol: FAM169B
  Gene Name: family with sequence similarity 169, member B
  ENST ID: ENST00000332908
  CDS Start-End: 1-576
aaggttcagtcgtttggggaaagggttgtgcttttcattctaaacgccattatttttggaagattggagagaaatttggatgatgatgacatgttttttctacctcactctgtgaaggaacaagctaaaatcctgtggagacgtggagcggctgttgggttttacacaaccaagatgaaaggcagactgtgtggtgatggcaccggtgcatgctacctgctgcctgtctttgacaccgtgttcatcaggaggaaacactggcaccgaggcttgggaacagccatgctgcgggacttctgtgagacattcccagaggacgaggccctgggggttagctgctcgatgtctcctgccatgtaccaagcacacccaggaaattccgaggacgtgagccgtcatgcgaggacttctcagaatgacagacccagacagcctgcccctggagacggcagcaaggagaggatgtgtggagaagaactggaagacacaaaggatgatccagagtgtggagtggaagaggaggatgccgggctggcagggcagccaccaggcaagcttacaaggtccagtccctga

SEQ ID NO: 132187 - DNA, 3298 bp, Homo sapiens
  Payload ID: 5810
  Gene Symbol: FAM169B
  Gene Name: family with sequence similarity 169, member B
  Uniprot ID: Q8N8A8
  ENST ID: ENST00000558256
  CDS Start-End: 251-829
aactccgcaagcaaatgaaaaacatcctggaattgtgaattcccctgtggcaagtggttatcgttcgtggtggcagtctgctgttacgagcataataggatgaatatggactttgacgtcagatggagctgacttggaatcctggctctgccagctgactggcagaggggttgtggctgtttacataaaggaatcctggtgctccacggaagatgcactaagaacctctgatcctgcaagagaagggttgatgaaggttcagtcgtttggggaaagggttgtgcttttcattctaaacgccattatttttggaagattggagagaaatttggatgatgatgacatgttttttctacctcactctgtgaaggaacaagctaaaatcctgtggagacgtggagcggctgttgggttttacacaaccaagatgaaaggcagactgtgtggtgatggcaccggtgcatgctacctgctgcctgtctttgacaccgtgttcatcaggaggaaacactggcaccgaggcttgggaacagccatgctgcgggacttctgtgagacattcccagaggacgaggccctgggggttagctgctcgatgtctcctgccatgtaccaagcacacccaggaaattccgaggacgtgagccgtcatgcgaggacttctcagaatgacagacccagacagcctgcccctggagacggcagcaaggagaggatgtgtggagaagaactggaagacacaaaggatgatccagagtgtggagtggaagaggaggatgccgggctggcagggcagccaccaggcaagcttacaaggtccagtccctgacgtctccagacgcccatctgggccaggtccagaggcctgcctgggctcccaggattcgggtctgagacttgtgtgtctgggagtgtaccttccctggggatctttgaggggccagtgaccccacgggccccacctacctctgaggtgggctcaggctctagagtacctgagaacgtgctgcgctcagcatgcgacaccgtgccacagtgaggaagtatttccctaagttaattgttgacagttcctaaacgtttcagaagcttactcgttaaaactaatgtggtttctgtttctcaggataaattggtgggactttaccggaaccacagggatgttttactgaatgtacctctttccttatagaagtttaaagatgctcaggaaggggccacacccgttccatctgggctgtagaaacccattgcaggtttgtgcatgccagccctgctgttgccgtgagaccacggacaccaaagaggtttgcaggggtacacgtgtcctttccggacaccaaagaggtttgcaggggtacacgtgtcctttcccgggaggcttcagccacatcagtgctgatgtgcctcaaggcacatgagtgccttgagggcaggggcagtggctggatggtgcctactgtaggcctggagctctcttctggcctggtatacagaaggcactcagagagctcatatgggaagtactgggtaggaatttgggcagatggtgcttctagaatattggtggccttgagtggaaagtcttgtggtagtaaaagtaactgaaaatgatagcctggctcgaatgtgacattggcttcccccttctcaaatactgatggagccctgtttggtcgctatagtgtatggccgctcttgggatgcagagacaaggacctgctcttaggccccaggtccaatgggctaggcagagttgtcccagggccgcctgccctcctcaagggtggggcgcaaatccaggctgctttagggagcccaaagcctgctccccgagaggtggggtggtgctttctctgctattgggcccagccttgctgatttcagtaggatttttcccagagaaagctggtcaggccctcttgaggcagacgacccaagttcttgcccctgcttttgggaaaatgcaaatccaatcccattgccgaggacatcccaaacccctctgtgctcatcactgactttggagaagccaggggccctgctgcctctgctccttgccattggagttcagctgcaggatcagccctgggctgcctggttactttgttgacagaagaagagggttttacctttttaggatgtaataaagcccctcctgtggcctgatgaggagactaccaacagtcccaagttctgggaatatatcgtctgttcccttgagcagtcaaaggacacacatggtgggacctgttatttattcatccatgcacccagctgtccatctctctgtccatccatccgtctatccatccatcatccatccatccacctaaccatccatctattcaatccattcatcatccatctatccatccctccatccatccattcatccatctatccatccatcatccgtccatcctccatccatcatccatccatccatcctccatccatcatccatccatccatccatccatccatcctccatccatcttccatccatccatcctccatccatccatctatccatccatccacccatccatccatccatccacccatccatcatccatccatccatcctccatcttccatccatccatccatccatccatccttcatccagccatccatctatccatacatttatcatccatccatccatcatccatccgtccatcctccatccatccattcatcctctatccatccatcatccatccatccatccatccacccatcctccatccatccatccatcctccatccgtcatccatccgtccatccatccatccatccattctgttgtacaacagatattcagcatgctttctcagggacatgctctgtgctggggacaggggatataagtgaggtatggatactggcctcaggaaactctcttctctttggaggaatctcttctggagtgttccactggagttttcatctctcttgcacccattacaaagatggaagggtccaattgactagaaatatagtttagagattcatatggagacatcatgaagcctgcctcccccctgccccttatacttgggctctctgtgcaggtggcacagaccataaaaggagagtgaagtctacagcctagagggtgccctgtgtgtggtgtcagatgtaacctttcacatgggatgtgtgtgctgtgagcattgtgctatttgagatgaatggttagtattttgtgtttacatgaaaataaatgtttaaaaatgtctcaggggtttgatgaagttactattcaataaaagaaacctctcagggaag

SEQ ID NO: 132188 - DNA, 1336 bp, Homo sapiens
  Payload ID: 5811
  Gene Symbol: FAM170A
  Gene Name: family with sequence similarity 170, member A
  Uniprot ID: A1A519
  ENST ID: ENST00000335286
  CDS Start-End: 172-1161
gctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatgtcaaagtcccaagaggatgccctgcagcctggatccactagagtggccaaaggctggagccaaggggtgggagaagttacttctacctccgaatactgctcctgcgtttcttcttcacgcaagctcatccacagtggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaactgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaacctta

SEQ ID NO: 132189 - DNA, 1234 bp, Homo sapiens
  Payload ID: 5811
  Gene Symbol: FAM170A
  Gene Name: family with sequence similarity 170, member A
  Uniprot ID: A1A519
  ENST ID: ENST00000379555
  CDS Start-End: 211-1059
aaccttaacagccctgcagtgtagtgggcactgggcagtgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaactgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaacctta

SEQ ID NO: 132190 - DNA, 1213 bp, Homo sapiens
  Payload ID: 5811
  Gene Symbol: FAM170A
  Gene Name: family with sequence similarity 170, member A
  Uniprot ID: A1A519
  ENST ID: ENST00000515256
  CDS Start-End: 173-1165
tgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatgtcaaagtcccaagaggatgccctgcagcctggatccactagagtggccaaaggctggagccaaggggtgggagaagttacttctacctccgaatactgctcctgcgtttcttcttcacgcaagctcatccacagtggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaacagctgagacttatgggccagaagatactggaagatggtgtggccttctcttgca

SEQ ID NO: 132191 - DNA, 642 bp, Homo sapiens
  Payload ID: 5811
  Gene Symbol: FAM170A
  Gene Name: family with sequence similarity 170, member A
  ENST ID: ENST00000509264
  CDS Start-End: 84-642
ctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatgtcaaagtcccaagaggatgccctgcagcctggatccactagagtggccaaaggctggagccaaggggtgggagaagttacttctacctccgaatactgctcctgcgtttcttcttcacgcaagctcatccacagtggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgaggcagctgagacttatgggccagaagatactggaagatggtgtggccttctcttgca

SEQ ID NO: 132192 - DNA, 1237 bp, Homo sapiens
  Payload ID: 5811
  Gene Symbol: FAM170A
  Gene Name: family with sequence similarity 170, member A
  ENST ID: ENST00000504819
  CDS Start-End: 211-1062
aaccttaacagccctgcagtgtagtgggcactgggcagtgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaacagctgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaacctta

SEQ ID NO: 132193 - DNA, 1374 bp, Homo sapiens
  Payload ID: 5811
  Gene Symbol: FAM170A
  Gene Name: family with sequence similarity 170, member A
  Uniprot ID: A1A519
  ENST ID: ENST00000613773
  CDS Start-End: 211-1200
aaccttaacagccctgcagtgtagtgggcactgggcagtgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatgtcaaagtcccaagaggatgccctgcagcctggatccactagagtggccaaaggctggagccaaggggtgggagaagttacttctacctccgaatactgctcctgcgtttcttcttcacgcaagctcatccacagtggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaactgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaacctt

SEQ ID NO: 132194 - DNA, 1233 bp, Homo sapiens
  Payload ID: 5811
  Gene Symbol: FAM170A
  Gene Name: family with sequence similarity 170, member A
  Uniprot ID: A1A519
  ENST ID: ENST00000620555
  CDS Start-End: 211-1059
aaccttaacagccctgcagtgtagtgggcactgggcagtgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaactgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaacctt

SEQ ID NO: 132195 - DNA, 1401 bp, Homo sapiens
  Payload ID: 5812
  Gene Symbol: FAM170B
  Gene Name: family with sequence similarity 170, member B
  Uniprot ID: A6NMN3
  ENST ID: ENST00000311787
  CDS Start-End: 91-942
gctggggccagctggaggccttcagtacagccccagccaactctcactgaacagctggagcaccgacaccctgggcactcatttcaaatcatgaaatgctacttcacagatcacaggggagaacagtcacccaccgatgggaccaccctcagcttgaccagccctgagtccactgaggagagtgtggaagtgttctggccagggactatacagagagaagggtcgtccccacggccggggcctgccattccccgggaggagggcctctacttcgctgccagggaccgggggatgcgggactggagcagctccccatcctcagagtcctccgagtaccagtcctactcccagtaccagtcgtgctgctcctgcatgtgcgatgaggacaatgctgctccgcagagtgtgtgtgccttctacacgcacgtgcagactgtgcggggtgtggctgtggcctgggagacggaggccggcttcgagccggtcaccaggaagccccgcatccatgaagcccagttcatcaagaggcagaggtggaacggctcctccttcgaaatggcttccaacaccgatatgcgctgggacctggaagcctgcaagagcaactgcagccccgagcccgaggacatagacctgctggagtgctgcctgcaggagctgcgggagccgccggactggctggtcaccaccaactacggggtgcgctgcgtggcctgctgcagggtcttgccctccctggacgctctgctggagcacgcccagcatggcatccgggagggcttcagctgtcagatcttttttgaggagatgctggagagaaggcgggctcagggccaagcacatgaccaacagctggaggaggagcagagtccttcagacaacagcgaatgttcccggccccagggtgaggtgctctcagcacagcagcaggagaagcagtgagccagaggggagatacccaaccctgccctcacctccagggcctgggactgctccttccccagccagcagtatcagagccactagggcagggagagaggaccagggtcagggggaaggaaaggcatggagtgtagagcaaggagggccaggagactggaaggaacccccttcctgccctaggcacagcatctccaccagagtccatttcaaaacccaaacgagagggctttgagtgtttctgatggcaggcacaacatctgaaacccacaaacgcatggccagagggatttctatttttgccggtggatcaggcaggtccacacttgctaagtatatgtgggtcacaggacagccaactgcaaattactctccagccctatttttttcactattacaaatctgtcatatgccctagttctatgtcttatgttattgggattaaacttgaataacacaaaa

SEQ ID NO: 132196 - DNA, 3952 bp, Homo sapiens
  Payload ID: 5813
  Gene Symbol: FAM171A1
  Gene Name: family with sequence similarity 171, member A1
  Uniprot ID: Q5VUB5
  ENST ID: ENST00000378116
  CDS Start-End: 8-2680
ggcggagatgagcaggtccgcgacgctgctgctgtgcctgctgggctgccacgtctggaaggcggtgaccaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaa

SEQ ID NO: 132197 - DNA, 605 bp, Homo sapiens
  Payload ID: 5813
  Gene Symbol: FAM171A1
  Gene Name: family with sequence similarity 171, member A1
  ENST ID: ENST00000455654
  CDS Start-End: 11-605
cgcggcggagatgagcaggtccgcgacgctgctgctgtgcctgctgggctgccacgtctggaaggcggtgaccaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgg

SEQ ID NO: 132198 - DNA, 3160 bp, Homo sapiens
  Payload ID: 5814
  Gene Symbol: FAM171A2
  Gene Name: family with sequence similarity 171, member A2
  Uniprot ID: A8MVW0
  ENST ID: ENST00000293443
  CDS Start-End: 162-2642
gcttgcggcggctccggtcggagacaatcgcgctgagcgggcgccgcagcgggagcgggagccggagctgcgaggcgcggcgcagagctggggctgcgcggggccgggcgagcgggaccaggcgggagccatggaccgctagggcccggcctagccccgcgatgccgccggcgagtggccccagcgtcctcgcgcggctgttgccgctgctggggctgctgctcggcagcgcctcccgggctcccggcaagtcgccgccggagccccccagcccgcaggagatcctgatcaaggtgcaggtgtatgtgagcggggagctggtgcccctggcccgggcctcagtggatgtgtttgggaaccggactctgctggcagctggcaccacagactcagagggtgtggccaccctgcccctcagttatcgcttgggcacctgggtgctggtcactgctgcccgccctggcttcctcaccaactctgtgccctggcgtgttgacaagctgcccttgtatgcgtctgtcagcctctacctgctccctgagcggccggccacgctcatcctctatgaggacctggtgcacattctcctaggctctcccggtgcccgctcccagcccttggtgcagttccagcgccgggctgcccgcctgcctgtcagctccacctacagccagctctgggcgtcacttacgcctgccagcacccagcaggaaatgcgggctttccctgccttcctgggcactgaggcctccagctcaggcaatggctcctggctggagctgatgcccctgactgctgtgagcgtgcacctgctgacaggtaatgggacagaggtgccgctctcaggccccattcacctgtccctgcccgtgccctccgagactcgtgccctcaccgtgggcaccagcattccagcctggagatttgaccccaagagtgggctgtgggtgcgcaatggcactggtgtaatccggaaggaaggccggcagctctactggaccttcgtctccccccagctggggtactgggtggccgccatggcctcccccacggctgggctggtcaccatcacgtcgggcatccaggacatcggcacctaccacaccatcttcttgctcaccatcctggcagccctggccctgctggtgcttatcctgctgtgtctgctcatctactactgccggaggcgctgcctgaagccgaggcaacagcaccgcaagctgcagctctcggggccctctgacggtaacaaacgagaccaggccacctcgatgtcccagctccacctcatctgtgggggacccctggaacccgccccgtcgggggaccccgaggctccgcctccaggccccctccactcggccttctccagctcccgggacttggcctcctcccgggatgacttcttccgcaccaagccgcgctctgccagccgcccggccgccgagccttcgggtgcccgcgggggcgagagcgccgggctcaagggcgctcgctcggccgagggccccggcgggctggagcccggcctagaggagcaccggcgggggccctcgggggctgcggccttcctgcacgagccgccctcgccgccgccgcccttcgaccactacctgggccacaagggggcggccgagggcaagacccccgacttcctgctgtcgcagtcggtggaccagctggcgcggccgccgtcgctgggccaggcggggcagctcatcttctgcggctccatcgaccacctcaaggacaacgtctaccgcaacgtcatgcccaccctggtgatccccgcgcactacgtgcgcctcggcggcgaggcgggcgccgccggcgtgggcgacgagccggccccgccggagggcacggcacccggcccggcgcgcgcttttccccagcccgacccccagcgcccgcagatgccgggccactcgggcccggggggcgagggcggcgggggcggcggcgagggctggggggccgggcgcgcggcgcccgtcagtggctcagtcaccatccctgtgctattcaacgagtccaccatggcgcagctcaacggggagctgcaggccctgaccgagaagaagctgctggaactgggcgtgaagccgcacccgcgcgcctggttcgtgtccctcgacgggcgctccaactcgcaagtgcgccactcttacatcgacctgcaggcgggcggcggggcacgcagcaccgacgccagcctggactcgggcgtagatgtccacgaggcgcggcccgcgcgccgccggcccgcgagggaggagcgggagcgcgccccgcctgccgcgccgccgccgccgcccgcgcccccgcgcctggcgctcagcgaggacacggagcccagcagcagcgagagccgcacgggcctctgctctccggaggacaactcgctgacgccgctgctggacgaggtggcggcgcccgagggccgggcggccacggtaccccgggggcggggccgcagccgcggggacagctcccgcagcagcgccagcgagctgcggcgcgactcgctcaccagcccggaggacgagctgggggcggaggtgggcgacgaggcgggagacaagaagagcccgtggcagcggcgggaggagcggccgctgatggtgttcaacgtcaagtagcgcccgcgcagggcctggcaccgcccctcccgcgcgggcccgcacccagggtgcgcgccccgggggcccgcgggggccctcgcgcgtagctcccagccccaggccggagaggggcccaggggccttggagctgttccgtggttggtgctgggtcgtgtcttgcaagggaccctgtgtctgcctccaagccggggaggagggggggtccagacccccacggggaggtgccggggaggagggctggggggaagcagtgcctgtgtagacgtggctgtacatagaaagctctattgtgggaaagcaggaggggtgacccagcctcagctgctagtgtgagggctgggaagggagggggcgttctttgtggacccctgggaggggagggggtgctgcttgctgactagcccatctctgggctacgatgtcacagggctggtggctgggacagctctggggactagggggtaatgtgatacagccgatgtgggcagcagcaaatataaaactggtgaggttaa

SEQ ID NO: 132199 - DNA, 1066 bp, Homo sapiens
  Payload ID: 5814
  Gene Symbol: FAM171A2
  Gene Name: family with sequence similarity 171, member A2
  ENST ID: ENST00000589407
  CDS Start-End: 99-578
ggagctgcgaggcgcggcgcagagctggggctgcgcggggccgggcgagcgggaccaggcgggagccatggaccgctagggcccggcctagccccgcgatgccgccggcgagtggccccagcgtcctcgcgcggctgttgccgctgctggggctgctgctcggcagcgcctcccgggctcccggcaagtcgccgccggagccccccagcccgcaggagatcctgatcaaggtgcaggtgtatgtgagcggggagctggtgcccctggcccgggcctcagtggatgtgtttgggaaccggactctgctggcagctggcaccacagactcagagggtgtggccaccctgcccctcagttatcgcttgggcacctgggtgctggtcactgctgcccgccctggcttcctcaccaactctgtgccctggcgtgttgacaagctgcccttgtatgcgtctgtcagcctctacctgctccctgagcggccggccacgctcatcctctatgaggacctggtgcacattctcctaggctctcccggctgtgccaggcattgtggctggtgctgggaaccacggtgaggaagaagacccgctctttgcctttggacgttcacagacaagtgcccgctcccagcccttggtgcagttccagcgccgggctgcccgcctgcctgtcagctccacctacagccagctctgggcgtcacttacgcctgccagcacccagcaggaaatgcgggctttccctgccttcctgggcactgaggcctccagctcaggcaatggctcctggctggagctgatgcccctgactgctgtgagcgtgcacctgctgacaggtaatgggacagaggtgccgctctcaggccccattcacctgtccctgcccgtgccctccgagactcgtgccctcaccgtgggcaccagcattccagcctggagatttgaccccaagagtgggctgtgggtgcgcaatggcactggtgtaatccggaaggaaggccggcagctctactggaccttcgtctccccccagctggggtactgggtggccgccatggcctccc

SEQ ID NO: 132200 - DNA, 964 bp, Homo sapiens
  Payload ID: 5814
  Gene Symbol: FAM171A2
  Gene Name: family with sequence similarity 171, member A2
  ENST ID: ENST00000588067
  CDS Start-End: 121-600
cgccgcagcgggagcgggagccggagctgcgaggcgcggcgcagagctggggctgcgcggggccgggcgagcgggaccaggcgggagccatggaccgctagggcccggcctagccccgcgatgccgccggcgagtggccccagcgtcctcgcgcggctgttgccgctgctggggctgctgctcggcagcgcctcccgggctcccggcaagtcgccgccggagccccccagcccgcaggagatcctgatcaaggtgcaggtgtatgtgagcggggagctggtgcccctggcccgggcctcagtggatgtgtttgggaaccggactctgctggcagctggcaccacagactcagagggtgtggccaccctgcccctcagttatcgcttgggcacctgggtgctggtcactgctgcccgccctggcttcctcaccaactctgtgccctggcgtgttgacaagctgcccttgtatgcgtctgtcagcctctacctgctccctgagcggccggccacgctcatcctctatgaggacctggtgcacattctcctaggctctcccggctgtgccaggcattgtggctggtgctgggaaccacggtgaggaagaagacccgctctttgcctttggacgttcacagacaagtaggaagacagatcattgcaagccctgaaatagttccagagcaggcagggcagtggagtggagggcagctgctttcagtgctgagacggccctaacctgcgaggggacctggctgggtgcccgctcccagcccttggtgcagttccagcgccgggctgcccgcctgcctgtcagctccacctacagccagctctgggcgtcacttacgcctgccagcacccagcaggaaatgcgggctttccctgccttcctgggcactgaggcctccagctcaggcaatggctcctggctggagctgatgcccctgactgctgtgagcgtg

SEQ ID NO: 132201 - DNA, 5826 bp, Homo sapiens
  Payload ID: 5815
  Gene Symbol: FAM171B
  Gene Name: family with sequence similarity 171, member B
  Uniprot ID: Q6P995
  ENST ID: ENST00000304698
  CDS Start-End: 204-2684
acatgcgcgaggatgcgaactccccttccctcctcctccgccccctccgcctcccgggcctcttcctcctgccggtgagggagtgcttggcagattgcgcgagggggagcgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgcatacctgcttggacatttgatatgaacacaggtgcttgggtaaatcatggtcggggaatggtcaaggaacataacaatcatttaatctggacatatgatgcaccacatttggggtactggatagcagctccacttccaggaactagaggttcaggtataaatgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagtacagttaaagttgcattaaaagctgaggacaagtcgcagttattcaatgccaaaaactcctcatatagtcctcagaaaaaggaaccatcaaaggcagaaacagaagaaagagtttccatggtaaaaactcgggacgattttaaaatctacaatgaagatgtttcatttctatcagtcaatcaaaataattactcaagaaacccaacacagtctttggagcccaatgtagggtccaaacaacctaaacatattaacaacaatctatcttcatctctaggtgatgctcaagatgaaaagaggtatctcacaggtaatgaggaggcgtatgggcgttcccatattcctgaacagcttatgcatatttacagccaacccattgccatccttcaaacatctgaccttttctccacaccggaacaattacatactgctaagtcagctactttgccaagaaagggacagttagtctatggccaattgatggaaccagtaaatcgagagaactttacgcagaccttgcccaaaatgccaattcattctcatgcacagcccccagatgccagggaagaggatatcatacttgaaggtcaacagagcctgccatcccaggcttcagattggagccgatactcaagcagcttactggaatccgtctctgttcctggaacactaaatgaggctgttgtaatgactccattttcatcggaacttcaaggaatttcagaacagaccctcctggagctgtccaaaggaaagccctccccgcatcccagagcctggtttgtgtctcttgatggaaagccagttgcacaagtgaggcactcctttatagacctgaaaaagggcaagagaacccagagcaatgacaccagtctggactctggggtggacatgaatgagcttcactcaagtagaaagctcgagagggagaaaacattcatcaaaagcatgcatcagcccaagatcctttacttagaagatttagacctaagcagcagtgagagtggaaccaccgtctgttcccctgaggacccagctttaaggcacatcctagatggagggagtggagtgatcatggagcaccctggagaagagtcgccaggaaggaaaagcactgttgaagattttgaagctaatacatcccccactaaaagaaggggcagaccaccactagccaaaagagatagcaagactaacatctggaagaagcgagaggaacgcccactgattcccataaattaactccaatggggattgtgtgtctgctgtctcgtgctgtttattcttgcttcttgttgtaaattgcagtacgaacttaagaaaatgagactgagcaatctcatggttcttggacatgtctcaagcagagtaaatggtaattcagtaatcagagagaaagataccaaggaatgctttttctggcctattcatttatttttgggtgatgaatttacagtatctaagttttcaaaatgtaaaatagcttcaagatgttagttatctgaaaatgttgctcagccagccagtttggccttgactctcttaagaataacagtgaaatatatactcctcaagttgcctccaaaaatgttgcctctaccatggtgactaccccatggaacatttagaaacaaaactgacttcaggcatcatattattttaaatgttactattacgtcttcttctgcctatacttaaaaataacttgataaatgacttggactgatgttactctggagttatcacaaagaaaatgttgtttggtctttaaagagcatgtgtattgtatcatcccaaacgtaaatcctacatttatataagatgggcaagaagctacttggtcattagagagggagacaccagctctttggttgtttttggatataactttacaaaataagtaagatgttaatttagaaatttgagaaattaatgctctaatactgagtttttatttaaaaattattttttcttcccctcaacaatgaagcaagcttagctgtcaagggaaactttttacaaatctgaaaaaaacaatctatgactttggtttaaggctcactgatacttttaggctaaattggttttaatatatttcttctattctaaaaacctgaactcagtcacttaaaggctatgaaatttaaaaaaaaagtcgatgtgaaagtttcttttgaacactaaaataaaatatgtgcagataaaatatacattgatttgtttttcttaaatgttgatgagaagaaaaagagatgccattttcctgaggctcaaaaataccttcaggatagttgtatatccagttattgattttcttaaaagatgtgtaaggaaaacagtttcaatttcaggggaaaagtaaaagtttttccctaagtcacttaaagcctttgcaacttcttttttcagttttgtaagtaatatatctatgttcttttcattatagcaagcattcaatgtgaacaactttttaattaactctgaattaccattcatacatcctaaaaataaaagctcgttattcattaaaatcaactgatcccatttttcttaaaatttccctgaaggcaaatgtctgaagcacctttcccttgtgggggtaaaaatcctaaattgctttatttttcattccctcctattcaacatgggagcagcatagagacccaaaccatgtaaacaagttcagtgaaccaaaacagccacattagcttcagtaaaattatagctagatgtgcaattttttcctccaacttctaacgtgtcaaataaccttcctactgttctgtgttaactgaaagaacataaagaccctaggcaaatatttgctatatattaccccaatccatagaagaaataatgttttgggtaatacctaggcttcctttttttttttttttttttttttttagtgataaggctcataacaattaattagagaaggcttcttattggtcttacacagaaagatacatcaaaagcagcatgactcaaaatgatttggaaaaggttaaagttagtgctctgctgaagtgcctttgatatagacttgcattattagaaggatataacatcttttttaagtgtgcattttctttcagttaaccaaattaaacagatgtgcagttttattaaaaatatagacctagtgtttcatgttggaacaataaatattgcatgtgagtagtatttcttgttttttgaatacagtatatattgataaattgtttatgttggaatgaagttagaaactatatagcaaaacattatattttaagtgtttatttttcccacctttaaataaaaatgtttcatctcagcttggtaatgaaatacacatattggtataagggtataccattcaggtatgccacttattttattcatttttgtgtaagggaaatgagatgatgtatcccaagggcttttctagaactacttgtttgctttcagaataaaaccttattattttttacactgcacatgctgttctcaattggtaattataggcaatttatcttttctaatgatcaaaagagtgtgacttctcatttgtgagtagttcacaaatttcctgttaaaaagctgaaaccatctactttttcttaacccaagtgataataaacaatattcacaactttcttaaatttttaaattgaaaaccaaggttttttcaaatataaacctagatgattttggtcacaaattgttaacatttgtcgatcctttgtatatactttggatatatattaaaggcaaaactatctcttgactaactgatggattcatttactaaagcacagctgtatgtatttttgaatacatattatgatcttgagactttataaatcaatttttatgactttatgcagttgtatagggattatgccctttcagttctatagggattatgcccttttataatacataatataccacagagattacaaatgttgaggaatgaaagcacttctttgctttggcaatcattttcagaccactatgtgtttgaatcctctggtatcaatacgtattatagggttttagagatctgtgggtcaaatgatgtccctcaaaacttcctaaaaaggtgaagctcaaagtcacacattcttataaggcgcatgagtttctcattttcccatgtacgagcattgtaaaggaattcagctgtattaatttctatttcagatctagaattgacattttgccttcttgtttccaggtgtttctattttttgtattctttcagagaaatctcatatttcggtgtatttattgctgttactactatatttactgctgaaaactgtaacaacctgaagatttgtaaaatgttaaacatagttcattaaaaataataaaataaatctaaaatgtacttgga

SEQ ID NO: 132202 - DNA, 940 bp, Homo sapiens
  Payload ID: 5815
  Gene Symbol: FAM171B
  Gene Name: family with sequence similarity 171, member B
  ENST ID: ENST00000612606
  CDS Start-End: 95-811
cgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactcaataaaccaggttttgaaaacattgaattgactcctcttgctgcaatatgtgtgaaaatatattctggaggaaaagaactaaaggtcaatggctctattcaagtttctcttcctcttctacgtctgaatgatat

SEQ ID NO: 132203 - DNA, 4312 bp, Homo sapiens
  Payload ID: 5816
  Gene Symbol: FAM172A
  Gene Name: family with sequence similarity 172, member A
  Uniprot ID: Q8WUF8
  ENST ID: ENST00000395965
  CDS Start-End: 144-1394
ggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctctttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttcccaacaa

SEQ ID NO: 132204 - DNA, 1031 bp, Homo sapiens
  Payload ID: 5816
  Gene Symbol: FAM172A
  Gene Name: family with sequence similarity 172, member A
  ENST ID: ENST00000509739
  CDS Start-End: 118-927
tgccaatttggataaacatggcacaaatccagcagggaggtccagatgaaaaagaaaagactaccgcactgaaagatttattatctaggatagatttggatgaactaatgaaaaaagatgaaccgcctcttgattttcctgataccctggaaggatttgaatatgcttttaatgaaaatcatcacgaagtatgtatatgagctcctggaaaaggattgtaatttgaaaaaagtatctattccagaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttctt

SEQ ID NO: 132205 - DNA, 1369 bp, Homo sapiens
  Payload ID: 5816
  Gene Symbol: FAM172A
  Gene Name: family with sequence similarity 172, member A
  Uniprot ID: Q8WUF8
  ENST ID: ENST00000509163
  CDS Start-End: 199-1311
gtatcaatctcctgaagaccccggaagtgcaactcgaacttggtcggggcgcggatcccgagagggaaagtcataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcac

SEQ ID NO: 132206 - DNA, 1392 bp, Homo sapiens
  Payload ID: 5816
  Gene Symbol: FAM172A
  Gene Name: family with sequence similarity 172, member A
  ENST ID: ENST00000502503
  CDS Start-End: 356-1273
gctgccgtcaagtgcgtaatgacgtatcaatctcctgaagaccccggaagtgcaactcgaacttggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgcctcttgattttcctgataccctggaaggatttgaatatgcttttaatgaaaatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcttttcatgttgccaaatgcaaagtcatgaagatttgctcctgtgttttcttctatgaattttacagttttatttattaaatttaggactttgatccatttcaagttaatttttgtatacggtatgaggcaccgaccgtcacgagctaacttcctggaagagctttccgtctatttt

SEQ ID NO: 132207 - DNA, 1387 bp, Homo sapiens
  Payload ID: 5816
  Gene Symbol: FAM172A
  Gene Name: family with sequence similarity 172, member A
  Uniprot ID: Q8WUF8
  ENST ID: ENST00000505869
  CDS Start-End: 171-1091
gcaactcgaacttggtcggggcgcggatcccgagagggaaagtcataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagaaaatggttctcctgaagaacatgcaatctatgtttgggatcatttcatagctcaggctgctgctgagaatgtgtttttcgttgctcacagctatggaggacttgcttttgttgaactgatgattcaacgagaagccgatgtaaaaaataaggtaactgctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaatt

SEQ ID NO: 132208 - DNA, 806 bp, Homo sapiens
  Payload ID: 5817
  Gene Symbol: FAM173A
  Gene Name: family with sequence similarity 173, member A
  ENST ID: ENST00000219535
  CDS Start-End: 134-790
ggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataa

SEQ ID NO: 132209 - DNA, 1052 bp, Homo sapiens
  Payload ID: 5817
  Gene Symbol: FAM173A
  Gene Name: family with sequence similarity 173, member A
  Uniprot ID: Q9BQD7
  ENST ID: ENST00000569529
  CDS Start-End: 301-1008
ccgcaaacggcggtccgcagagcggaccaacggagccgaccctcgcaggcttggagccggacgcggcggggcagagcccccgaggctgcagctcgccggaacccgcgggagggcagccgggctgggcggagcgcacagcgccacggaccgaccgcgcaggctctgccggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtgagcctgagggactgccgcaacgtgtctgtgttcctggcccctagcgtgctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtgggttctatcctgactcat

SEQ ID NO: 132210 - DNA, 1088 bp, Homo sapiens
  Payload ID: 5817
  Gene Symbol: FAM173A
  Gene Name: family with sequence similarity 173, member A
  ENST ID: ENST00000564000
  CDS Start-End: 179-703
tgggcggagcgcacagcgccacggaccgaccgcgcaggctctgccggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtgagcctgagggactgccgcaacgtgtctgtgttcctggcccctagcgtggtaggtgcggggttgccagccccgctgggaagccccagccacaccccagggtgtttgctgctctgaggcctgggcctgcctggtgggtgctaggcttggggctaggggggtgagcgcggctgttttctaccggccccgcccccgccccctctactctgctgttctctccctcagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtggg

SEQ ID NO: 132211 - DNA, 454 bp, Homo sapiens
  Payload ID: 5817
  Gene Symbol: FAM173A
  Gene Name: family with sequence similarity 173, member A
  ENST ID: ENST00000568916
  CDS Start-End: 1-421
ggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtgggttcta

SEQ ID NO: 132212 - DNA, 1928 bp, Homo sapiens
  Payload ID: 5818
  Gene Symbol: FAM173B
  Gene Name: family with sequence similarity 173, member B
  ENST ID: ENST00000280330
  CDS Start-End: 608-817
aaaacgctgttggaaatctcgcgatggagggaggaggaggctggtctcaaattcccgggctcaagcgatcttctggcctcagcctcctgagtagctgagattacaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccgtttgtacctgcaactacgaagcagattgaaaatgttgtgaaaatgttgcgatgccgaagaggatcccttgtggacatcggtagtggggacggacgcattgtgagttctgctaaaacattttaaggtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaacttgactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagtggggaccaatttctaaaactcatggcacctagtctttggtccataaatggtgtttgttattttagacactgagaaaaatcttattcacagaagttgcagattatttctgctagtcacttttttatttcttgagagctgccactcatttaatatttctcatttatgagaagagacttgactgatttagataaaagacgaattaaggaaaacctttgaacgtgagtagacaagcttcatatatctgtaaagtgaatattgaatggtagcttgagtcattcgtacttatcacagaaaagaattgaactcccagtcatacacctgtaactgaaataccaaactgtcttaatggagatgtaatgaagtaagatggtcacatctttaactaaacttataaaaattggtc

SEQ ID NO: 132213 - DNA, 1160 bp, Homo sapiens
  Payload ID: 5818
  Gene Symbol: FAM173B
  Gene Name: family with sequence similarity 173, member B
  Uniprot ID: Q6P4H8
  ENST ID: ENST00000510047
  CDS Start-End: 25-675
aaaaacgctgttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccgtttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaagatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaacttgactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatt

SEQ ID NO: 132214 - DNA, 1423 bp, Homo sapiens
  Payload ID: 5818
  Gene Symbol: FAM173B
  Gene Name: family with sequence similarity 173, member B
  Uniprot ID: Q6P4H8
  ENST ID: ENST00000511437
  CDS Start-End: 14-715
tggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccgtttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaacttgactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagt

SEQ ID NO: 132215 - DNA, 571 bp, Homo sapiens
  Payload ID: 5818
  Gene Symbol: FAM173B
  Gene Name: family with sequence similarity 173, member B
  ENST ID: ENST00000504390
  CDS Start-End: 13-342
ggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccgtttgtacctgcaactacgaagcagattgaaaatgttgtgaaaatgttgcgatgccgaagaggatcccttgtggacatcggtagtggggacggacgcattgtgagttctgctaaaacattttaaggtcatagcggctgcgaagaaagggttcacagcagttggttatgaattaaacccatggctagtttggtattccagataccgcgcttggcgagaaggtgtgcatggatctgccaaattttatatttcagatttgtggaagatgctgcagttggagaagaaacttgaacgtgaacttgaggatgatgcacgagttattgcttgccggttccctttcccacattggactcca

SEQ ID NO: 132216 - DNA, 751 bp, Homo sapiens
  Payload ID: 5818
  Gene Symbol: FAM173B
  Gene Name: family with sequence similarity 173, member B
  ENST ID: ENST00000506108
  CDS Start-End: 16-465
gttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccgtttgtacctgcaactacgaagcagattgaaaatgttgtgaaaatgttgcgatgccgaagaggatcccttgtggacatcggtagtggggacggacgcattgttatttttattgcatattattacttgttcacaaaaccatcctcccagacactttcatttcactgctgctgtgctagcccactgatggagagatgcagtggattttcagcaatgttttgttcgacctccccgggggttggctgacctagaatcaattatggaggtgttccaagtgaacctgaatgtctattctgatacttgaggtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttga

SEQ ID NO: 132217 - DNA, 1356 bp, Homo sapiens
  Payload ID: 5819
  Gene Symbol: FAM174A
  Gene Name: family with sequence similarity 174, member A
  Uniprot ID: Q8TBP5
  ENST ID: ENST00000312637
  CDS Start-End: 227-799
aagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaa

SEQ ID NO: 132218 - DNA, 2792 bp, Homo sapiens
  Payload ID: 5820
  Gene Symbol: FAM174B
  Gene Name: family with sequence similarity 174, member B
  Uniprot ID: Q3ZCQ3
  ENST ID: ENST00000327355
  CDS Start-End: 300-779
ttcaccacggggtctcaagtcccgaggaattggggtcgcgggcgagcggagcgcagccgggacccaggccgggtggcctgccccgcccacgtggggccgcggcccgtcgaatgactccttgcaacgtgttggtggtggcggcggcggtggcgcgggctcttccgggcgccgcagcttcctgccaagcaccgcgcagccgcctccgccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgtggcccgaacccgagcgcgagtcgcggccaccgcccggcccggggcccgggaacaccacccggtttgggtctggggcggcgggcggcagcggcagctccagctccaacagcagtggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttaaaaaaaaaaaaggttcagcagaaatcagcgtggctagttcacaaagaatttccagtatcagggaaaaactgtgcgtgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaccatg

SEQ ID NO: 132219 - DNA, 866 bp, Homo sapiens
  Payload ID: 5820
  Gene Symbol: FAM174B
  Gene Name: family with sequence similarity 174, member B
  ENST ID: ENST00000555748
  CDS Start-End: 355-696
cgcgacctacccaccctcaaggcagccgtgatcgtggcgttcgcctttaccaccctcctcatcgcctgcctgctgctgcgcgtcttcaggtgggccctcccgccctcttccttcccccgccggccgacagggcggcatcgccaacctgctgtcgccgcgcgcccgccccacctgcacgcacaggtgccctggtgcgccccagccagccgtgtgcctcctgccctgcccgggagagtgggtggggggccggggtgtgctcgtctggattttcctggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggacccc

SEQ ID NO: 132220 - DNA, 555 bp, Homo sapiens
  Payload ID: 5820
  Gene Symbol: FAM174B
  Gene Name: family with sequence similarity 174, member B
  ENST ID: ENST00000557480
  CDS Start-End: 227-555
ccttccttccttcccctctcctcttcccctctctctctctttctctctccctctctccctcttggtttctcttttcttttctttctcagtgagaaaccagaatgggaaatatctactggagggtgaagatacaggaggaagcagaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctt

SEQ ID NO: 132221 - DNA, 464 bp, Homo sapiens
  Payload ID: 5820
  Gene Symbol: FAM174B
  Gene Name: family with sequence similarity 174, member B
  ENST ID: ENST00000556824
  CDS Start-End: 191-464
tgtcatgtgtatttaactgtttacccaccaccgaaaagcttcctgccaggacccatctgcagtgtaaaaggggaaccctgaagccctgggaatggctcctagtacttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccac

SEQ ID NO: 132222 - DNA, 621 bp, Homo sapiens
  Payload ID: 5820
  Gene Symbol: FAM174B
  Gene Name: family with sequence similarity 174, member B
  ENST ID: ENST00000555064
  CDS Start-End: 168-509
aaaagaacttgcaggggcacctctgggtcctgagaagtgtctgttgaatgccgagtcgtagggttggggcacatccagaggtccgaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtc

SEQ ID NO: 132223 - DNA, 567 bp, Homo sapiens
  Payload ID: 5820
  Gene Symbol: FAM174B
  Gene Name: family with sequence similarity 174, member B
  ENST ID: ENST00000557398
  CDS Start-End: 367-567
aatgcattaattcgatccaagaggactcgcctcgttggatttgcagcaacctaatctctcgctcaggaagaaaacgccacgataaagagttttctgtcctccttgtttgcacggagcagcaaacgcagagacaaaagaaacgggccccgactggtggtggcagaagtgggatccaaagtagagcttctcgtaacccccagaagcactgagtgaccaagtgtgacaccagctggactcattgtgtccattgctctcttgcagcacctggggctcatgggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggc

SEQ ID NO: 132224 - DNA, 548 bp, Homo sapiens
  Payload ID: 5820
  Gene Symbol: FAM174B
  Gene Name: family with sequence similarity 174, member B
  ENST ID: ENST00000555696
  CDS Start-End: 156-497
aagtttacgacttcataggagaagctggttatggacatgatctgcgtctcttcccaggaaggcaatcttgttagggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaat

SEQ ID NO: 132225 - DNA, 495 bp, Homo sapiens
  Payload ID: 5820
  Gene Symbol: FAM174B
  Gene Name: family with sequence similarity 174, member B
  ENST ID: ENST00000553393
  CDS Start-End: 166-279
gcaaacacacccgagagctggaggaacaggtcttggggcatttgctgttgccggatttactgtgtgctgcttttgtcttggaagagtcgggaaagaggttaaagaagacacgcaagtatgatatcatcaccactccagcagagcgagtggaaatggcgccactaaatgaagaggatgatgaagatgaggactccacagtattcgacatcaaatacaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaa

SEQ ID NO: 132226 - DNA, 4291 bp, Homo sapiens
  Payload ID: 5821
  Gene Symbol: FAM175A
  Gene Name: family with sequence similarity 175, member A
  Uniprot ID: Q6UWZ7
  ENST ID: ENST00000321945
  CDS Start-End: 110-1339
gccggcgcaggccccgcctcctcgctgggccccgcctcgctgccaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagttaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaagtttgcaatttttttttttgagatggagtctccctgtgtcacccaggctggagtacagtggtgctctctcgcctcactgcaacctccgccacccaggctcaatcgattatcttgcctcagcctccttagtaactggaattacaggcatgcaccgccacacccggataatttttttgtatttgtagtagaaacggggtttcaccatattggccaggctggtcctgaactcctggcctcaggtgatctgcccacctcagcctcccaaagtgctgggattacaggtgtgagccaacatgcccagcctcaacaagtttttaagtcaaggattggtaaatcatttttgtcaagggccacaataataatctaggttttgtgggccatacagtctccatcactgccactcaactctgctgttgtagctcgaaaacaaccatatggcactacgtaaacaaaactacaaaaacaagtggggttgggtgcagtggctcacacctgtaatcccagcactttgggaggcctaggcaggtggatcacctgaggtcaggaattcaagaccagcctggccaacatggagaaacccaatctctaaaaatacaaaaattagccaggcgtggtggtgcatgcctgtaatcccagctattcgggaggctgaagcatgagaatcacttgaacccaggaggcagaggttgcagtgagccgagattgtgccacagcactccagcctgggtgacagtgagattccatctcaaaaaaaaaaaaaagtggcatttgtatatgatgaacctaatcaagataaaaagggagcaggtcgaatttggcctatgggccatagtttgctgacaccaagtttaagtatcaatctaggaatgattatagtatattccaaaacatcaacaacagttttttaaagcccagtttttctatatagttaactctgcataagacagcaaaataataatcctcttggcctaagagactttttcatagtaactagctctagtccctgtagtatctgatctagtagtaatttatagcacaatttgaaaatttgagttttcttaaatgatagaaatagattgatataattcgtatctacatttatattcccataataaaaaagaacatacctgtaatgtgccttccataaatgcatccagtaaatggagaaacaaactgggacaaaagctgttttggagttttatgtggaggggaaaaaaaagtatctgttatttatttctgaatgtgtaaatttcaaaaaacaaccttcaggttatataaagctttactaaatttcagacacatttcataaaatataagaaaaaaatattgttatcctcctgttaccttttaaatattttctatccagtgtgtcaagtctatatataattaaacagcagattaatcagca

SEQ ID NO: 132227 - DNA, 1732 bp, Homo sapiens
  Payload ID: 5821
  Gene Symbol: FAM175A
  Gene Name: family with sequence similarity 175, member A
  ENST ID: ENST00000515303
  CDS Start-End: 145-393
gggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgatggagtctcattctgtcgcccagactggagtgaagtggcatgatctcggctcactgcaacctctgcctctcgaggtcaagcgattctcctgcctcggcctccggagtagctgggattacaggcacacgcaaccatgcccggctaattttttttgtatttttagtagagatggggtttcaccatgttggccaggctggtctcgaactcctgacctcaagtgatcctctcacctcggcctcccaaagtgctgggattgcaggcgtgagccaccatgcccggccaaatgtgtatactttttatttacacaaatgggatcttactatatgtgcctaatatctcccaagatatcacaagtacagaatagtatctgtgtgtataattcatcactctttgttttttttttttttgagatgaggtcttgctctttcagccaggctggagtgtagtggcacaaacactggtcactgcagccttgacctcctgggcttaagcaatcctcctgcctcagcctcctgtattgctgggaccataggtatgcaccaccacgcctggctaattttttattgtttgtagagacaggttctcactttgttgcccaggctggtctcaaactcctaggctcaagcaatcctcctgtcattacaaagtgtttggattacaggggtgagccaccatactcggcccatcattctttctgctggctgcatatatcctgttgtatagacgtaccataatttttttaaccatctaagaatgattttctgggtttttttgttaacataaacagtattaccatgaacatttagtattgtacatttctttgtgctgttgagtgtatatttgaaagtcacactcctggaggtagactagctgattgccttttggaaaacttatgccattttaggcttctccacagtatataaaagtgcctaggtccccatactctttttttttttttttttttgaaacagagtctcactctgtcacccaggctggagtgcagtggtgggattccggctcactgcaacctctgcttcccgggttcaagtgattatccctgtctcagcctcccgagtagctgggattaccggcgactgccaccacacccagccaatatttgtatttttagtagagatggggctttgccatcttggccaagctggtctcaaacacctgacctcaggtgatctgcccgccctggcctcccaaagtgctaggattacaggcgtgagtcaccatgcccggcccccatgctcttgccaacactaggtattatcaaatcttttaatctttgccaatttgataagtgaaaaaaatagcattttaatttgcatttcttaattacaaaagaggttaagtatttttttgatactttttactttttttcttggccattttctctgaaaaggataggcctattctttggctgcatttgtactgttttgcttttagtgatttgtaatcacattacttaaggaaactgggcttttgtcatgttttatacatatgctaatacagtttataattttttttctgtcaataaacactttaatgagaacc

SEQ ID NO: 132228 - DNA, 682 bp, Homo sapiens
  Payload ID: 5821
  Gene Symbol: FAM175A
  Gene Name: family with sequence similarity 175, member A
  ENST ID: ENST00000511801
  CDS Start-End: 32-145
gtcctcttgtgtagcctgaggcggcggtagcatggagggggagagtacgtcggcggtgctctcgggctttgtgctcggcgcactcgctttccagcacctcaacacggactcggacacggtcgggcgcggtggctcacgcctgtaattccagccctttgggaagccgaggcgggtgaatcacctgagcccacgagttcgagaccatcggggacaacgtagtgagacccggtctctacaaaatctaaacattacaaaattgctctttggcacaatcctaataaaggttggaattggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaagg

SEQ ID NO: 132229 - DNA, 2718 bp, Homo sapiens
  Payload ID: 5821
  Gene Symbol: FAM175A
  Gene Name: family with sequence similarity 175, member A
  ENST ID: ENST00000475656
  CDS Start-End: 32-256
gtcctcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagttaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcat

SEQ ID NO: 132230 - DNA, 1869 bp, Homo sapiens
  Payload ID: 5821
  Gene Symbol: FAM175A
  Gene Name: family with sequence similarity 175, member A
  ENST ID: ENST00000506553
  CDS Start-End: 327-1409
attagtattctgtaagtttcagtgagtgaagggtgctaaaatgcagcttgaaaaccaaaaccgtggcatatccactgtggcatcgtaatgttgctactcaactcttttattcttgtaatcattgcttgtcttaaaatgaccctgtcaaccgtgttcattttgatagctttgcatgtttgtgacaggtcgctcagcaggcgcaggccaccaaaagcaattcgcagccctctgcagtggtaccgacatgcagcggccttccgggagaggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagttaggagttagagaccagcctgggcaacgtattgagaccatgtctattaaaaaataaaatggaaaagcaagaatagccttattttcaaaatatggaaagaaatttatatgaaaa

SEQ ID NO: 132231 - DNA, 847 bp, Homo sapiens
  Payload ID: 5821
  Gene Symbol: FAM175A
  Gene Name: family with sequence similarity 175, member A
  ENST ID: ENST00000505489
  CDS Start-End: 188-847
gggacttctaataccccaacactacaaagctttagattttcagtattcgtaaggaaaggtgtgatacctttcctcactcatcaccagggtcacagccaacagccctataacaaaagacaggttaacaagagaaaagaacgacaaatttatttaatcaaagtttaacacgacataggcgccttcagaaatgaagacctcaagccccaaggaaaactgtctatttttatgcttcacttcgatgaagaatggacaggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaag

SEQ ID NO: 132232 - DNA, 595 bp, Homo sapiens
  Payload ID: 5821
  Gene Symbol: FAM175A
  Gene Name: family with sequence similarity 175, member A
  ENST ID: ENST00000503217
  CDS Start-End: 29-595
ctcttgtgtagcctgaggcggcggtagcatggagggggagagtacgtcggcggtgctctcgggctttgtgctcggcgcactcgctttccagcacctcaacacggactcggacacggtgagccgagggacggggcggggtccggcgtcgcctgggaagagccctgcgcgcggcctgcctccccgctgttgctccggtccccgcccgctcccccgacgccgccgcgcctcctccctgcggtcgcggctctgccttctctccccctcagcggtccctgaggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctatta

SEQ ID NO: 132233 - DNA, 655 bp, Homo sapiens
  Payload ID: 5821
  Gene Symbol: FAM175A
  Gene Name: family with sequence similarity 175, member A
  ENST ID: ENST00000611288
  CDS Start-End: 1-597
ctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagctctactccttttctgaatgtcatcttcatccaggatccaggctgaaggagcagcccttatttgggacatgtcctcatggcataaggcaaagagcaagaaagctagtggattacaggcgtgagccaccgcagctggcccatgagttaatatttcagtttatttctgtatattttcagcgaactaactggcatgataaaagctgtataaatgagaagttacatgtgaaaaagcattttacaacctataaggcttatttataacctacaagtgcttgttactgacatcctccagaaaataaataaaatttatataaaaggc

SEQ ID NO: 132234 - DNA, 2992 bp, Homo sapiens
  Payload ID: 5822
  Gene Symbol: FAM175B
  Gene Name: family with sequence similarity 175, member B
  Uniprot ID: Q15018
  ENST ID: ENST00000298492
  CDS Start-End: 46-1293
gtgtgccctccgcggggcatgatggggtagctggagatttccatcatggcggcgtccatttcgggctacaccttcagtgctgtgtgtttccacagcgccaacagcaacgcggaccacgaaggatttttactgggagaggtaagacaagaggaaacgtttagcatcagtgactcacaaatcagcaacacagaatttctgcaagtaattgaaatccataaccatcagccttgttcaaaactttttagtttttatgactacgcaagcaaagtgaatgaggagagtttggacaggattcttaaagatcggagaaagaaagtcattgggtggtacagattccggcgcaatacgcagcagcagatgtcctacagagagcaggttcttcacaagcagctcacccgcatcctcggcgtgcccgacctcgtctttcttctcttcagcttcatctccactgccaacaattccactcacgctttagaatatgtgctcttcagaccaaatagaaggtataatcagaggatatcactcgctattcccaatctaggaaatactagccagcaagagtacaaagtgtcttcagtgccaaatacttctcagagttatgccaaagtgattaaagaacatggtactgacttttttgacaaggatggagtgatgaaagacatcagggcgatttatcaggtttataatgcacttcaggagaaagttcaggcagtgtgtgcagatgttgaaaagagtgagcgagttgttgaatcttgtcaggcagaagtgaacaaattaagaagacaaatcactcagaggaaaaatgaaaaggaacaagaaagaagattgcagcaggcagtgttaagcagacagatgccgtctgaaagcttggacccagcgttcagtcctcggatgccgtcctctgggtttgcagctgaaggcagaagtacacttggagatgcagaggcctcggatcctcctcccccttactctgattttcacccaaacaatcaagaaagtactttgagccactctcgcatggaaaggagtgtctttatgcctcgacctcaagctgtgggctcttccaattatgcttccaccagtgccggactgaagtatcctggaagtggggctgaccttcctcctccccaaagagcagctggagacagtggtgaggattcagacgacagtgattatgaaaatttgattgaccctacagagccttctaatagtgaatactcacattcaaaggattctcgacccatggcacatcccgacgaggaccccaggaacactcagacctcccagatttaactaaacaaaagaaactctccacctagcactgtttttcttcattgcttactgagagggtttttgagaacttaatctggggggagaactgctttctcagataccttaactcccgagaagagagtccttgtgcacagaacttgtgggagcctccatccgctgctctttacctttggatacagtgtgcaagtttcatgacagaatcattaagataatcaaattgtcctaattctggtgcgattcatggatatactggtaaatttaggcaaagtgaaacttatcagcgtagtttctgttctttaaaataaattggaaattagagactaagcacaattagtctataaatgttctataaatcaaaaacttacctcttgcactatcatgccttgaaatttactttttcaaagggaaacaagtttagcagcagccttcaaagaacttctttctatgatgagccaaattcatctttgccagaaaagaaattttgataattccaagaagcctgattagaacaaatcagatataccttctcttgtctgcatgactttgtgagataaaagagagggcttccaacttttttctactagcttgatatgtattatcacttaaaatggttgcctttaaaaaaaaaaagtagagatactaattaccagtaagtaatcatccaaataaatacgtcataaaataaattaattattttttctttgatggattacagtgactactgtgttgcactggcacatttatggtctctgttctggaatcttggaggacacacagcagtggagaacagaaggagtgagttttataatgaacagattccagacacggtaggtttagctgagttcatacagaggagatataactcatttagatcttctgacaaatcctagtgttagttttatctgtggaggaaagacatttaataataaactgtttgggaatcttggtgaataaagattcattttcaagctgaataaccatacttattttattttaagttgccatttggggaataattgcagtatgtgtagagactctcttgggatgcacttatatttttatttaatgactacttgttttctagttttgcccacaacgtctgaaaccactaagacattcaggagcatgttgagcttctggtttggaaacagcaagacccaccatttatgacaaggacagccatgaggttaatacttggagtttaactgccttccctttgaactagttaaaatctgtaagaataaggaagttgttgaaggcttaaaatctgggttctgaaaaagtagtttcagtttataggatacacatttactcactgagctccagttccaatactaaattagacagtatcatatagacggaaaatgaaatgctagaactgccgttctttggatcgccactctatgggggtctgtcttttaactactctcctggttatgttggccttacaccactgccatttgatttaaaacgctgcagaccactttatctgcaaatgtgttccagttgttatcagctacctactacgcagcttcagcgccagtgtgaatttatttttttttaagtgccattaccgtctcctctgttcagattttgacattcaggaaaatatttttattttgatgccatactgaaatctacaatgtatatctgacaaagcagttaaatgtgacaataaaaaacttatttaatcatggta

SEQ ID NO: 132235 - DNA, 2927 bp, Homo sapiens
  Payload ID: 5823
  Gene Symbol: FAM177A1
  Gene Name: family with sequence similarity 177, member A1
  Uniprot ID: Q8N128
  ENST ID: ENST00000280987
  CDS Start-End: 62-772
gcgggtgagtcccacttcccgacagcctggctcggccagcgactgggcggggagaccaaggatggaagtgggcttaccggccattaccctctttctcaccagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtattcaa

SEQ ID NO: 132236 - DNA, 858 bp, Homo sapiens
  Payload ID: 5823
  Gene Symbol: FAM177A1
  Gene Name: family with sequence similarity 177, member A1
  Uniprot ID: Q8N128
  ENST ID: ENST00000382406
  CDS Start-End: 58-699
aggcgcggcgcgaggcgggcgctgggcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatct

SEQ ID NO: 132237 - DNA, 3254 bp, Homo sapiens
  Payload ID: 5823
  Gene Symbol: FAM177A1
  Gene Name: family with sequence similarity 177, member A1
  Uniprot ID: Q8N128
  ENST ID: ENST00000396472
  CDS Start-End: 460-1101
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtattc

SEQ ID NO: 132238 - DNA, 731 bp, Homo sapiens
  Payload ID: 5823
  Gene Symbol: FAM177A1
  Gene Name: family with sequence similarity 177, member A1
  ENST ID: ENST00000553955
  CDS Start-End: 1-23
ttctccgcgggccgctcttttagcctgcgcggccgtcctccgagcaggccgccccagctttggagttcctcctcactgcacccctgtttctgctcactgagaccagcttgtgggaaggagcgccccccgcctcactcaccaaccccttggctggcagcacagcagactctggggcggcctcgggttcctggggtgatagtccagcttctggtctaccagaggaagaagaaaggcgtgtcccccaaaggctgtccttgcagtagctggaagccaggtgagggcggcttcaaccacttctcagtctcttctggtgcgagcgcctgcctgggcatctgccctttgcttggcatatgccaaacgtttaccagctttaattcactggatccttacagtaaccgctcgagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcgg

SEQ ID NO: 132239 - DNA, 516 bp, Homo sapiens
  Payload ID: 5823
  Gene Symbol: FAM177A1
  Gene Name: family with sequence similarity 177, member A1
  ENST ID: ENST00000553852
  CDS Start-End: 1-111
gcggccgccgcggcattcggggaatctgcagggcaggtaggtggggccgccgaggctgacgtccggggagccgagccgcctccttgccttctccgcgggccgctcttttagcctgcgcggccgtcctccgagcaggccgccccagctttggagttcctcctcactgcacccctgtttctgctcactgagaccagcttgtgggaaggagcgccccccgcctcactcaccaaccccttggctggcagcacagcagactctggggcggcctcgggttcctggggtgatagtccagcttctggtctaccagaggaagaagaaaggcgtgtcccccaaaggctgtccttgcagtagctggaagccagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatg

SEQ ID NO: 132240 - DNA, 476 bp, Homo sapiens
  Payload ID: 5823
  Gene Symbol: FAM177A1
  Gene Name: family with sequence similarity 177, member A1
  ENST ID: ENST00000555211
  CDS Start-End: 250-476
aatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagt

SEQ ID NO: 132241 - DNA, 499 bp, Homo sapiens
  Payload ID: 5823
  Gene Symbol: FAM177A1
  Gene Name: family with sequence similarity 177, member A1
  ENST ID: ENST00000554794
  CDS Start-End: 79-499
taccaaaagtttttcacgtgtaatgaaagaaaattaatctcacttgaaactcattttcttaaaatatcgttgatatagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattcca

SEQ ID NO: 132242 - DNA, 912 bp, Homo sapiens
  Payload ID: 5823
  Gene Symbol: FAM177A1
  Gene Name: family with sequence similarity 177, member A1
  ENST ID: ENST00000555260
  CDS Start-End: 1-148
gaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggttaagtaacttgtattatcaacttctgatgcagcttcccaaagccaccaattaccctagttatgggcccatcatctcacctggactatcatgaaagacagctcttgattcctctcttaatttctgtagtaagacttcatcttcagcaggcagctgaaaatacaaggtctttagacaaactcagccaagtgtcaaccagaaaacatttgaatttacctgtagcctggaagccccacttcaaattgtcccacctttctggatcaaaccaatgtatttctcaaatgtatttgattgatgtctcatgcctccctaaaatgtatgaaaccaagctgcacccaaaccacctttggtacatgttctcaggatctcttgaaggctgtgtcacaggccatggccactcatatttggctcagaataaatctcttcaaatatt

SEQ ID NO: 132243 - DNA, 617 bp, Homo sapiens
  Payload ID: 5823
  Gene Symbol: FAM177A1
  Gene Name: family with sequence similarity 177, member A1
  ENST ID: ENST00000556858
  CDS Start-End: 1-118
ggcattcggggaatctgcagggcaggaaattaagggatccaaaaagctgagtcatggtccaaaaggaaacgttgatgtcaggacagccatagccaaattttatctcaaggatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgatttggctttaaatatttggctattagaaaatcatgccaggtgtggtggctgacacctgtaatcccagcgctttgggaggtcgaggcaggcagatcacctgaggtcgggagttcaagaccagcctgaccaacatggagaaaccccatctctactaaaaatacaaaaaaattagccaggcatggtggtgcatgcctgtaatcccagctacccaggaggctgaggcaggagaatcgcttgaacccaggaggcgaaggttgcggtgggccaagatcgtgccattgcactccagcctgggcaataagagcgaaacttggtctcaaaaaataaaaaaa

SEQ ID NO: 132244 - DNA, 540 bp, Homo sapiens
  Payload ID: 5823
  Gene Symbol: FAM177A1
  Gene Name: family with sequence similarity 177, member A1
  ENST ID: ENST00000554052
  CDS Start-End: 12-281
ggagaccaaggatggaagtgggcttaccggccattaccctctttctcaccagcgccagcagccctgtggtggcgacgacgatggaccaggagccagtgggcggtgtggaacgaggagaagccgtcgcagcctcgggagctgcggccgccgcggcattcggggaatctgcagggcagaatctcactctgttgcccaggctgaagttcatggcgcgatctcggctcgctgcaacctccacctcccgggttcaagcaattctcctgcctcagcctcctgtgtagctgggattataggcacgctccaccgcgcctggctaatttttgtatttttttagtagaggtgggatttcaccatgttagccagggtggtctcacacccttgacctcaagttgtctgcccgcctcagtctcccaaagtgctggggttacaagcatgagccaccatgcccagccacagtgtaaattttatttgtaattattggatttctggttcaagttgatgtttgaaaaataaaaaaagaaaaatattttaaaaatataa

SEQ ID NO: 132245 - DNA, 764 bp, Homo sapiens
  Payload ID: 5824
  Gene Symbol: FAM177B
  Gene Name: family with sequence similarity 177, member B
  Uniprot ID: A6PVY3
  ENST ID: ENST00000360827
  CDS Start-End: 150-626
ggagtgttcagtgttgatttgatgtgaggtgtgattaaagaagaaccaagaatgactttagtgttgttggcctgagcaactggaagaacagagttgccatttattgagatgagaaggctgccagaagagtagagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaatatcagtatgtgttaaacgagttctataggatacaaaacaagaaaagtgacaacaaaagtgaaaggagaggatcaaaggcccaggcagctgaggttcctaatgaaaagtgtcacttggaggctggggtccaagagtatggaaccatacaacaggatgtgacagaggccattcctcagtgaagcacctcatccagggagggtctggtggcagatcctagctcatgatggcagcaaagactgcagtttccctggatctgttccttggccattgattaccatggcaacaacaccagaggtagcacttctgagccagatctg

SEQ ID NO: 132246 - DNA, 1994 bp, Homo sapiens
  Payload ID: 5824
  Gene Symbol: FAM177B
  Gene Name: family with sequence similarity 177, member B
  Uniprot ID: A6PVY3
  ENST ID: ENST00000391880
  CDS Start-End: 267-629
agatacagcagtgaacataacaggtaaaaccctccccctctgccaaggggcaggacagggaggaaagggaagacagagacaggtggaatatggagtgttcagtgttgaaatatccaagacaatttcctggcagatttgatgtgaggtgtgattaaagaagaaccaagaatgactttagtgttgttggcctgagcaactggaagaacagagttgccatttattgagatgagaaggctgccagaagagtagagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctatgctgagcctgcaggccaccttgctactgaaggcagaaaaggaaggccttaaacaacttctgagaagtctgtctggatgcatggaagaattcctgatgtgggtcttggtaacactggattgagtttgggtttaatttgaaatatacttggagcagatgtttagccggtatgcatggggataatgaacaatacctgttctgattgctcaggacccatgctatacctgttgttaaagtatattgaaaatctctcctgatatatacatctggaaaaaatagtttatatataatcccatataaagatagaagatttgacaaatttcctttgaatcctagaatttttgagaggccaaggcaattgaaatgttttgtcagccttgaagttaagtatagtaatagaccactattactatactatcagaatagtttaaactctgggcatctcaactgatgcgaagctttagttagtaattcagtttacgcaagtgctcgttctttcttttagcatgtgaattccttggtggaagatttgctgtcttctttggtcttactcaacccaaatatcagtatgtgttaaacgagttctataggatacaaaacaagaaaagtgacaacaaaagtgaaaggagaggatcaaaggcccaggcagctgaggttcctaatgaaaagtgtcacttggaggctggggtccaagagtatggaaccatacaacaggatgtgacagaggccattcctcagtgaagcacctcatccagggagggtctggtggcagatcctagctcatgatggcagcaaagactgcagtttccctggatctgttccttggccattgattaccatggcaacaacaccagaggtagcacttctgagccagatctgatcctaatctctgtgtgacttagtctcaagcatccaggaattacaagcaataatgagagtaattttggacactttctcagaataatttctatattcaagccaccccacctcaactccacccctgtgatacaagtcccatgagtactgacatttgcacagtagcataaatgccttaaggaactttgggactgggagtttttggctgaaatcctctgtcatgggacgagggtacagtaaagaagctctattcctcagaagaaaatttgggcaccgcaaagtctaaataaatcccctttcaggatttgatatagtgtgtacttccaacaaccatcctggcgtagttggggattgttttacaataagtaaacattgctaataactgtgttacaagatcattatcaagatctttaagaattaggtacatccctccaaattaaaacaattgataaataatataagctctagaaaaaaatattaatggattattttcttatttatttgtcaagaaattttcaaaacctggaaagatcgaacatggaaatcattgttagataacacagggtgtgctggccaaagtaactgtgatacattaatagcaaaaaacaaacc

SEQ ID NO: 132247 - DNA, 466 bp, Homo sapiens
  Payload ID: 5824
  Gene Symbol: FAM177B
  Gene Name: family with sequence similarity 177, member B
  ENST ID: ENST00000434700
  CDS Start-End: 166-466
aggggcagaagatacagcagtgaacataacagatttgatgtgaggtgtgattaaagaagaaccaagaatgactttagtgttgttggcctgagcaactggaagaacagagttgccatttattgagatgagaaggctgccagaagagtagagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaatatc

SEQ ID NO: 132248 - DNA, 545 bp, Homo sapiens
  Payload ID: 5824
  Gene Symbol: FAM177B
  Gene Name: family with sequence similarity 177, member B
  ENST ID: ENST00000456298
  CDS Start-End: 248-545
agcatatccaagtgcactgtatggcctcagcctacagaacccttaactcttaaatttatcatctattgaacaatttctaacatcaaaatttgtactactttcaacaccaaacatcactaattaatgaaagaaaaatacagaggaattattcataacctaatgatcccagcaagataatgtcctgtcttctaagatgtgcatcaagcctggtacatactgaaaatcctataagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaat

SEQ ID NO: 132249 - DNA, 1096 bp, Homo sapiens
  Payload ID: 5824
  Gene Symbol: FAM177B
  Gene Name: family with sequence similarity 177, member B
  Uniprot ID: A6PVY3
  ENST ID: ENST00000445590
  CDS Start-End: 18-494
agttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaatatcagtatgtgttaaacgagttctataggatacaaaacaagaaaagtgacaacaaaagtgaaaggagaggatcaaaggcccaggcagctgaggttcctaatgaaaagtgtcacttggaggctggggtccaagagtatggaaccatacaacaggatgtgacagaggccattcctcagtgaagcacctcatccagggagggtctggtggcagatcctagctcatgatggcagcaaagactgcagtttccctggatctgttccttggccattgattaccatggcaacaacaccagaggtagcacttctgagccagatctgatcctaatctctgtgtgacttagtctcaagcatccaggaattacaagcaataatgagagtaattttggacactttctcagaataatttctatattcaagccaccccacctcaactccacccctgtgatacaagtcccatgagtactgacatttgcacagtagcataaatgccttaaggaactttgggactgggagtttttggctgaaatcctctgtcatgggacgagggtacagtaaagaagctctattcctcagaagaaaatttgggcaccgcaaagtctaaataaatcccctttcaggatttgatatagtgtgtacttccaacaaccatcctggcgtagttggggattgttttacaataagtaaacattgctaataactgtgttacaagatcattatcaagatctttaagaattaggtacatccctccaaattaaaacaattgataaataatataagctcta

SEQ ID NO: 132250 - DNA, 1004 bp, Homo sapiens
  Payload ID: 5825
  Gene Symbol: FAM178B
  Gene Name: family with sequence similarity 178, member B
  Uniprot ID: Q8IXR5
  ENST ID: ENST00000393526
  CDS Start-End: 251-610
cacaggggtttagaattgactggtgtaggagcagaggacctggggctggatctgggcacagcaatttgcagggcactgctgggcaggagtccctgatggccaagctgctgggctctgtatctcccacaagctgcagcggaggccccatggagcaggagcagaagcacacgttggagaactgaacttgaaggacaggacttacagcattgaggtcacacagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaaagggacagggtcagggcagcccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccctcctcccagccatctcctcttccctaaggcctctgtctccatagctctggtttccctgggcctcagtcctccccaccctccttcctctgtctccctgtcactaatgtgaggtttctttgtgcacattaaagtcttctttcagcatca

SEQ ID NO: 132251 - DNA, 2710 bp, Homo sapiens
  Payload ID: 5825
  Gene Symbol: FAM178B
  Gene Name: family with sequence similarity 178, member B
  Uniprot ID: Q8IXR5
  ENST ID: ENST00000490605
  CDS Start-End: 280-2319
ggaagagggtgcgcacttggccggcgagctccccagctggcggcggcggcggctgtgagctggccgcttggtttggagtcggaactcaatccccagaactggatctttaggttccacgttggcggccctggatctagggacgcaactcttggggtcctcccactgcgccgcctggggagcctgctcctgcttcctttcccggctagctggccccgtcctctgaggccgtgcgaattcccgccaccctccctcaccccggagccctgcccttcccgccctatgtggccaaggcttccaggtgcgggcctcgctccacaactcaggaggcaggatcagcggctccattttacaggacagatgtcccacggcttgcagatggctgggccccaggagacggtgctagcccttcctctgagagaaggggtgcaggctgccgccaccgtgcccatcctcctgtacaacctggaggatggcttgtcagaccatcccctggaccaggggccccgctgccctgcccggcggccctgcagccctgcctcggctccagctcccacatcgccaaagaagcccaagatacaggcacctggggaaacgtttcccactgactggagccccccgcccgtggaattcctcaacccgagggtgctgcaggccagtcgggaggccccggcccagaggtgggtgggtgtggtgggcccccagggcctgaggagactggctggtgagctgcccgaggagttggagcaggaacacctggacttggacccgaagaggggcctggccttgccagagaagctgttctggaacacgtcaggcctgagccagcaggctgcggccccagagttttcctgggggggctcaggaagctacttcaacaacctggactacttactgcaggagaagagggaacaggccctggagcaggagcgagagaggctgcttctgcaggagtgtctcaatctcaactccttggatcttgatgaagaggaagtgccactcacacccgagcacaggatgctggtggaaaagtactcagtgtccctgcagaccatcccgccggtccatccaggtgagactgtgtttctgcccaggtgtcaccccctgccatgcatcctggactcctcactcctgaagccacgcagccacctggaagggctgttcctcagctccccgccagcccaacagctctccttcctgcgcagtggcctcctgaacatcctctacctgcacatgcctgactgcccggtatccctgctccagtggctgttccagctgctgacatggcctccagaaacatctttgggagcctttggtcttctgtgggatctcattgtggatggaatcttccttcagcctgatgaagacaagcacctgtggtgcccctcactgcaagaagtcagggaggcattccacagcctgggtgcccacagtcctgccctgtaccctctggggcccttttggcacggtggcagggtgcttccaggcgaggctggcctgaatgagaatgaggagcaggacgctccccaagagattgccttggacatcagcctgggccacatctacaagtttctggcgctgtgtgcccaggcccagccgggggcctacactgatgagaacctcatgggactgattgagctgctgtgccgcaccagcctggacgtggggctccgcctgctgcccaaagttgacctccagcagcttctcctcttgctcctggagaacatccgggagtggccagggaagctccaggaactgtgctgcaccctgagctgggtgtctgaccaccaccacaacctgctggccctcgtgcagttcttcccagacatgacctcccggagcaggcggcttcgaagccagctcagccttgtggtcattgctcgaatgctgggccagcaggagatgctccctctctggcaagagaagacccagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaaagggacagggtcagggcagcccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccctcctcccagccatctcctcttccctaaggcctctgtctccatagctctggtttccctgggcctcagtcctccccaccctccttcctctgtctccctgtcactaatgtgaggtttctttgtgcacattaaagtcttctttcagca

SEQ ID NO: 132252 - DNA, 12691 bp, Homo sapiens
  Payload ID: 5826
  Gene Symbol: FAM179A
  Gene Name: family with sequence similarity 179, member A
  Uniprot ID: Q6ZUX3
  ENST ID: ENST00000379558
  CDS Start-End: 352-3411
gtttattcaaggagagctttgctgagagctggagcacgccagcagtggagctcgtggccacccagcccctgctcagacaggaggctgcggcccaggactgtgtggctggtgggggccagggtgggccaggcctggggctgccccgtccttgcctccctgggcccatgagcatcaacgtctctatagagaccaaggaccctggattcctccagtgacaggggtttggcctctggacagagaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactcggacagctgggtggcctcaagctggacaccccttccaagggctggcaggcaaggaatggtcaccccaggaacctcagggccttgtctttgggggaccagcccctggtgctcctcccttctccggagtcagaggccaacagcgtggccagggacaccatccagattaaggacaagctcaagaaaaggaggctctcagagggcttggcagcgtcttcccgagcctctctggatccagggggaggcccccaaggagttcccctgcacagcaccatcccccgagccacctctcagaggctgctgagggtgcccaggccgatgcctctcatccagagcatccctaccacccctgaggccagcggagtcaaagagaagggcctggacctaccggggagcattccgggtcctcacgagttgagacccggtgctcaggaggcgcagatctcctggcaatacctgcactgcaatgatgagaagatgcagaagtccctgggcgccatcgtgatcccacccatcccaaaggccaggacggttgcagcgaccccctcccgtgtgcctggctcccttcccagcccgttacctccaggccagggagtcctcacaggcctgagggccccacgcacgcgattggctcgggggagtgggcctcgggagaagacccctgcatctctggagccaaaacctttggcctcacccatcagagacaggcctgccgctgccaagaagcctgccctgcctttttctcagtctgctcccacgctgacagccttctcctttgactgtgccagagaagcctgccctccgctgaaagaagaggaccagaaggagatcggcaccaagatccaagtcaccatctccaagtctgcccgggagaagatgcagctgaagcagatgaaggagatggagctgcttcggaggctggaggagcccaggacagggcaggagctcacttcccagtgcctgggctcccagagagccttcatgaaggaaggcctccttcccctccggggcagcgggacactgtctgtgcccactaggctgagcggcccatgcagaaacgacgtcagcatcatcctgaggaagtgggccagccgggcctccctgcccagcatccccatcagccggcaggagccccgctttgcccgccacgcctcagctaactcattacctgcggtgctcacgttggggtctcctgaatgggaagaagaggaggagatggatcttagagcctgtaaggagttgaggcctttctcgaacccggagctggggctgagggatgcactccagtgcctcaacagcagtgactggcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaaggttttattatcttgtacttttttaatcacagagaattttccagtaactaggtttgtgatgaacgaaatgaaatgtgacagcagcaaaaccagttgcagacaatgttgagacaaagagttaggaagaaaaagggtagcacagccctgcaagctgcagcccgctcgagacgatagttgcccatctgtgagctgctgggcaagccctcctgaaacccgcagcctgagttggtcatcgaatccagtccatttgttatgggcctgattggaggtgagtgtaacaaacgtgttcagggacatcgtgcttctgccctgcaaaagctgcagcacgtgtctgttggtcctgtgggaaccttctgatcggcccagcttatcaaaagacaaggggaatttgagatttgcatcactaaaagccttctctagaagttggagttctggctagttctgaagaggactagacaatgctttgccattgaaacaccctaaatggagatgcatgtggagcgtaaagtgctaccagtgtgcagatgctgccgagtctctgaaactgcacaggctgcaattgtgggccacatcacaaggctggaggggcgagtgggcacagcacgggccaggacttgtggaagcagggaaggtgttggcccctgggggaacagccagtgaaatgaagtcccggcagtggagagggaagtctggggctcaggctctggacactttaggtaggagtggctctgccttggctggggccagtggcaggttaacaactgtgtgaccagaaagagttagagctaaggccatgacctcaaatgcacaggcaaggcaggcctggtaaggcaaaggctgaagaggcagcatcccagctcttgcaggggagcccagcctgcagccacgtgctggggcagatccagacgaccgaggccctgagggcccagcctcatgccagcaagttttctggcagacacccccctcccctgcccttccccagtggaacctctttccactgtcatctgccccccaggcctaacatccattccacatccctgttctgagcctctcctggggagtctggctctggaaagccccgaatctactcacttatgtatttccataccccaccaggctgaggaagccactttcccatcttgcctctgtggcaggtgtagttagtccggcccctccttacgccctggggtgaggttgggcctgcgagtcatcccgggccttgggcttgtcataggcggcttaagagtgactttgggtaattctagcccagtgagctgcttctcacctgattgtgaccccagcaggggcttccctgcgaccatctagctctttgttgattctgattgaaccaggttaaaggcctgctagacaggcagccatccaaaaatgcccaagaggctgacagtaaatgttttaagtgttgaacaatttaatgaattgcatttgcctgtcatctgagcaaatgtttttggtttggtgaggagacttgcattttctgcttttatcctagaatgtatcagaacatttcagggttttttagatccctaggaggccagggacgtagagtctggcaaggattttgacggcagaaatgaagcttagcagtactgtcctgtcttcctgccttccatgtgtgttctcacacaggaagcttcccatcccatgggcctccacccactctcaggggcggaggcattgaaaacagctgaaaacagtggaaaagtgcagaatacatctttgcactgttctcttttccctcattatttcaggttttattaaccacacctgtggtgtgacgctgctgggaggcactgggtggctctggtgtaccttgagaaatttccatctccaaagacttccttacctcattacttttaaaatgaagggaagacagcatgttggtaacctggccctgggcctgttgggaatacctgtgggaatctaatgggacggcctgtcatgggacatgaagattttcctaagagctggggctggagctaagcccacacatactttgcttggttctgtgtgtggccaggaactccacttacatgagatgctcttgggggtgggaatacagcctctaatgatggaagattctctttctctcaatctctctctccatgtaacaaaaatgcaggtgcagtcactcactgcttgcagactccagtgaacaaaagggaggcctggtataaagaaactgactttttattccaaagctagtttaggggaagaagctgccttgaagggtactgtgtcgtttttggagcagaaagtgggcacttttaaaggggcgggggggggggtgctggcacgaatggcatgcaggagaggaagcgggcaggtgggggagtccacatacttgctttgatgacttatgtaacgggtggtcaagttggcatcttcgtgggcagaactaggttgtaaagtggctgaagctctccgggtgggagggagtttcatagtgggcatattttgggttattaattgactgttgtgtctccaggcagtttcctggtgggtgcaagttctgctctagagcttctaagcacacagttagatgagcctgccctggagggagtgtctggtaaaggggaggtaaaaggttatagttgcatttcttttatatatatgtttatttgtttatttatttattatactttaagttctagggtacatgtgcacaacgtgcaggtttgttacatatgtatacatgtgccatgttggtgtgctgcacccttaactcgtcatttacattaggtatatctcctaatgctatccctcccccctcccccaccccacaacaggccccggtgtgtgatgttccccttcctgcgtccaagtgttctcattgctcaattcccacctatgagtgagaacatgcggtgtttggttttttgtccttgcgatagtttgctgagaatgatggtttcccgcttcatccatgtccctacaaaggacatgaactcatcattttgtatggctgcataatattccatggtgtatatgtgccacattttcttaatccagtctatcattgttggacatttgggttggttccaagtctttgctattgtgagtagtgccgtatagttgcatttctaaagggctaagtaggaagtggggaacaaggggaaatggggaaaagagaagagaaataattttaaaaactcgttttcttagaaaaatgagtgtactcagttcagagtgagactcatagacagaagacttgtctgagagctgtaactgccaggattcccttttacatcaaggagaatttttttgagattttaggaaacttttcctataggtcccattgtggcaggccaggtatcactaatgcaggcatccataacaactgtttcaatactgactgagtggttaagttaaacattaaaagctgagagagctggtggccttatacaaaggctggaatgtaacaaaagcccaccaagagtttgcctaggcctttgctgggccttgaagcatgatgagataatgaaggaattcttagtgggacctgtttaggattaaacaagctttactgggtgtctgaagaaactccccaggcctccaaaaacaagtttattggaggtctgaaggaactccccaaaccttcaggatttagcaggagacaagataagggtaatcaccccagcacctggacccatttagattaagtaaatctattgaggctccagaggaaggtcttcaggacttagatgttagctacagattaaaagaaattaatcgcttatgtctttagatgagtgcacacttacacatagacatgtagcttagaagatatgcaagctctggaaaactttgtaatttgagttggtctggcgatattttccaggccttctccctgtaaccggttatggaaataaaaaactctcttcctccccagttcatctgcatcttgttactgggccacgagaaatagcagcccaaccctcagtttggtccaggaacaaaatctctcatcttgttttctcctccctttattatctcctacctgctgagataataaacgtttctaccctctcactgtgcttcggaatcatctggcaagacttaaaaaatactgaggtctacccccaccccacagggattttgattcacttggtctgaggtgaagcctaggcagctgtatttttttttcttttaactccaggtgattctaatggctgggtgaattcaaaaaccacaataaaatatcagataaaaaaggaaactggccatggcttaggccctgtgggctcctggcctgccagctccccttacctcacagccctagagtattctggggttgacggtagaaactgagtccaggctctggagtcaggcctgtggcctgctggcgtgtggcttgggacccatctatcaacctctctgatctttccatatcaatctagtgtgtggatgacatcaatgcccacctacacctggctgtggtgacgatgactgagaacattctcataaagcatttagcataaggccacgaaaacagggagctgttctgcttggggcctgccatttctccagctgtcttaccctttctccagacgccctcagaaccatccctccccccagagaagaaaacccagaagctcttctctccttgtggctgttccttcccctccactcttctgactcttgagactggagaggggatgatttgcaggggagcagagtgctttcttgcctaaagcattttcctcttattataacttggttctgccattaggaaaagaaagggggaaatgaccataagtctcctgctctccttgtgatggagggaggaagatgggggcccagaaagggaagccgagaggaagagccaacctcctcattaaattctgcagtgttccaggtctgccattcttcttgacatcttataaggaagatattatttcttccatttcctgatgaggaaactgggcctcagcgatgcttaatgaataaccgcagccagtgcacaggaatcacctgggaatcttggtaaagttcagattctgcttcagcaggtctgggtggggcctgagagtctgtagtgttcaattcccaggtgaggtcaatcctgtgagtctggcagggaccacactttgaggcgtcaggtcctaagacagcaagaaagtggctgaaacttgggtgtgtgtccaggcctgtttgactccaaagcccctgactttctgttccaggatgttttatggctccaagacatttacctccccttgggtcagtttgagccctttgaaataagccacggaaaccccatggatttctggagttagtctggtcccagagttttgctcccaaaagcttcagggcagagagggtctgcttggtcagctctgatcattaggacatgctgtgaacacttggcctctggtggggacgggatttgtggacacaaatgaaggctacatgagcaaagtgtagcctattcagagcttgctatagcaagggagcctgccatgacgacctgagttttggcagagactcatatgcaagcagaggtaatgctgcagcttcatagtggaaaaaggggagacttcaggtatgccctgattggaagctgttggcctggggacgctgtaggcacgaagtgtggactgtggcttgcttgttacagtatcacccacggtgcttgttaaagtacagatccctgggttgtactgcagacctaccgaatcagagccttgatcactcaaagttgagaacctctgtcacaatctcaaagctttcagtggttattaggttcccaggctagcccacacctgggagtcagcatccctaaatcagtctttaccaaatgtggttgatgaaaagaattgcttgcgggaggagaacggggagagagagacgggaacaagtgctttttaaaaactcagactcttagtctcagctgtagatctgttactggggggaaggcctgggaatctgcaaattatcaagcagctgattctgaggatcaggaagcctgggaagcagcgtcctaactgcctgctcccagccgggttccagacagcacggcagcatcactgtgtgcacagatgctccctggtgggtgtttctgagtcagggacctcttgggggctcaggtttggtccttatgattactggggtttattcagggggcgtgctggtttcgccatattccgtcccctggtgtttcagtgaagctggctgtaacatttgaaggctttgctttattttaatcacatctttataattacctcgctgtgagttgacagctgttattaacatcaccttgggttctccttgagaatttttacatccttaaagtgatgcggcacttctgcagctgaagtcagaagccgttaactaaataatcgctctaaaatgtcaccaggttttgtaaacatagccaatactgtccccttccaaaggaggaaaaaaaattgctagataaataattttcatgaaggcaatttgtttcccagggtctatattattttctgtctcatccactggtttttgccgctgtggggcactggcaataaagagctgtctcaagaaggaggccacgtctgctcctgccaattttcatctggaagcccacttcagggttcatggcaatgagaagcaaagatttttggaaaagacttttctttttctcttaatgctagcagcagttgtgtgtgtgtgtgtgtgtgtgtgtgtgtgtgtgtgtgtgtgtgtgtggaaaatgatgggagtggttgaggttcatagagggaattattttaaaaactcttggaaacattgttttgagttttcatccaagctagtttgaggaatggctagaatttcagctgaactttgattagatatgaaaagtaatgtcctgggctaggtgtggcagctcacacccgtaaacccagcactttgggaggctgaggtgggaggattgcttgagtctaggagtttgagaccagtctgggcaacagagcaagaccccatctctacaaaaaaataaaaaatcgtagctgggaatggtggtgcatgcctgcagtgccagttaatcaggagactgaggtgggaggatcacttgagcttaggagttcgaggctgcactgagctacagtgagctatgattgtgtcacttcactccagcctgggcgacattgagtgagaccctgtatctttaaaaagaaaaataatttcctatttgtaaatgttggagaaaatggagaatttcttccatagaaaggtatgctgtctccttccagtactgcctctatggaataatctagatcttgctttcagcaggtatcaggaggaaggctggccagggtaagaggcctgctctgccctcactggcaatgtatctttggagtgagatctttttttcatgtgtaaaaggtattgaaaaaacacttgctttgtccatctcatagcgtcttttttcctctaaagatttaatgaaacaatgtacatgattgcattttgaaaaagtagagtgttacatacaaagaaaggtagaattattaactggagcctcatcccacactgtgtgcaaagcctgctgtttagcagtgttcagagtaattgccagtcatctatctgactgactgacaagcctcatgactcaacatgggaaagatgagagattcagaggcttaatttgtttttttccatgtggtatatttgacatatgtacttgcaattgcaagcaaatattgtaaagtcttttctcttcactttgaaagacatgaaaaccttcaaagaaggaagtcaattcttgctgagtttgacagctgtttttaagtttctccaaagatcaaagcgcagcccaggaatgagggggaaatgatattggcttcttttctcaatcgggatcttaaagtgcggaggcagcagagatgaacactaaagaccaaaatggccaggattatgagttccgttccccgaggtggctcaaaaagatgccttagaaaagacaggtttgcccctgttgtgcagatggcaggataaataggctgacattattatcactgctttgcagatgaagacacgggctcagagatgccaggtcacagagccaggggatggaggtgtcatgactcaggctctggtgttctaattccaactctcaggagcgtgataccctctggctcctgagaatgcgtggcccatttaccataccccttgtttctttcccctcctgctctcttcctcctctttttcttcttcctccaatttaggccagtcagctttatctatgggcattaactgagccccgccagtgctatcactccagccaaaaccgattgctgcctcgtgtgctagacttcaaggctgtctgcagtgacagcgttcagaagcgggtgactagatcagtggaatcctagagccacctgatgcagggcccaccgaccattcacaaagttactttgtgaagtccaggagtgcgatcaagcctgcagtgtccagggtccttcctaaaattgaattagagtgctgagtgaattaactgtttgctcctcttcttgtgtgatgcatttttaattacatttcataaaaacgtctggatggattgatggagctttagttaaacttcaggtaggcagggggagtagacgatggtgcagtataacatgttctgttaatacaggctcagaacacatgtactttatggcagttcaactgaatctttgatgtagggctacttaaaaatatattacctttgaaaagatttcctttgaaagatagagtgggtgctttagcagcctgtaagccgtcagccagacgatcaattgacaaacacgtcagcacttataattcactgcagcggctcccctgatacatgcaaaacactggtttatttcagaaaaagaatatatttctcaaaatccctttcattcacattgtaaggtttatgaggcaagtcttgtcaatcctaggcccttcacaatgaaagaaaagtctctttggtctgtctgccctgcgtttcctacaacatggattattttaggctctgaactgggcatacgatgtgaggaaggagaatagatacggcttaaagtaaacagcagctcagaccccagccacggagggaggttatatttcattttgaagattgtatttatacttgcaaaaagctatcactgttctgccagaatatgatgtttact

SEQ ID NO: 132253 - DNA, 720 bp, Homo sapiens
  Payload ID: 5826
  Gene Symbol: FAM179A
  Gene Name: family with sequence similarity 179, member A
  ENST ID: ENST00000401723
  CDS Start-End: 234-720
cttggggtgcttcctgtttctcagtaaagtgaagttgcggcgacctcgtgcctgccttatgtgcacctgtgccagcatctttctcaggtcccggatgttacagagaagcctgccctccgctgaaagaagaggaccagaaggagatcggcaccaaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttga

SEQ ID NO: 132254 - DNA, 658 bp, Homo sapiens
  Payload ID: 5826
  Gene Symbol: FAM179A
  Gene Name: family with sequence similarity 179, member A
  ENST ID: ENST00000440012
  CDS Start-End: 321-658
caaggaagcagctgtgaacagcagaaagaggatgagaggattggggaagacctcggtttctttcctgttgcttcataaaatgtcagggctggacagcactggctacagacaggaatcagagggtccagagcttctaccagggcacctcaggaatcgtgcctgggacatggggacgctctgtccccattctaccagaggagcttctatgttgcctcattttttttttttgtatactgggcattcatgtgagatttcatttggaaagattttgctactgaaaaaaacttaaaaacagtcagcttggttcagagtttctgcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtcta

SEQ ID NO: 132255 - DNA, 493 bp, Homo sapiens
  Payload ID: 5826
  Gene Symbol: FAM179A
  Gene Name: family with sequence similarity 179, member A
  ENST ID: ENST00000420297
  CDS Start-End: 287-493
tttcactccggctggccctggctcatctccttgaggaggaagtgtgtgtcctctcctgcacgcctctccttcctggggagccctggctcacagctggagccagcaggcctggaggctgcagaccctggactgggacttgttgcttttgagagctcccctgaagcctggctcctcaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactc

SEQ ID NO: 132256 - DNA, 6375 bp, Homo sapiens
  Payload ID: 5827
  Gene Symbol: FAM179B
  Gene Name: family with sequence similarity 179, member B
  ENST ID: ENST00000361462
  CDS Start-End: 184-5505
agacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaagccatttacacattgctgtaagaaggtgtacagcccagcatttatcagatgtattggaatttatggaaccagaacgtattttatctgcagcaaaggatatggctgaacgcatattaccagctgctgctaagtttgctcaagacagttcacaagaaaccaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttcttta

SEQ ID NO: 132257 - DNA, 6247 bp, Homo sapiens
  Payload ID: 5827
  Gene Symbol: FAM179B
  Gene Name: family with sequence similarity 179, member B
  Uniprot ID: Q9Y4F4
  ENST ID: ENST00000361577
  CDS Start-End: 215-5377
cgcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttcttta

SEQ ID NO: 132258 - DNA, 710 bp, Homo sapiens
  Payload ID: 5827
  Gene Symbol: FAM179B
  Gene Name: family with sequence similarity 179, member B
  ENST ID: ENST00000556823
  CDS Start-End: 1-468
tctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattca

SEQ ID NO: 132259 - DNA, 479 bp, Homo sapiens
  Payload ID: 5827
  Gene Symbol: FAM179B
  Gene Name: family with sequence similarity 179, member B
  ENST ID: ENST00000557250
  CDS Start-End: 1-479
gttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaaggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagag

SEQ ID NO: 132260 - DNA, 544 bp, Homo sapiens
  Payload ID: 5827
  Gene Symbol: FAM179B
  Gene Name: family with sequence similarity 179, member B
  ENST ID: ENST00000555874
  CDS Start-End: 22-544
gttgccagagtctgctgtaggatgttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagct

SEQ ID NO: 132261 - DNA, 6232 bp, Homo sapiens
  Payload ID: 5827
  Gene Symbol: FAM179B
  Gene Name: family with sequence similarity 179, member B
  Uniprot ID: Q9Y4F4
  ENST ID: ENST00000557423
  CDS Start-End: 210-3197
ggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagaggtcagacatatttccaacatttgggtcaaaaccttgtccaacaagactttcttctgcaaagaaaaaaatttctcatattgctgaacaaagccccagtgcaggtgttccctcggaagttaggaattccctttctctccatattgctgcgtgggcatggaggactagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaagccatttacacattgctgtaagaaggtgtacagcccagcatttatcagatgtattggaatttatggaaccagaacgtattttatctgcagcaaaggatatggctgaacgcatattaccagctgctgctaagtttgctcaagacagttcacaagaaaccaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttcttta

SEQ ID NO: 132262 - DNA, 1800 bp, Homo sapiens
  Payload ID: 5828
  Gene Symbol: FAM180A
  Gene Name: family with sequence similarity 180, member A
  Uniprot ID: Q6UWF9
  ENST ID: ENST00000338588
  CDS Start-End: 267-788
gtgctcaaaaacagagtctctctgtggaaggccagttccccaatcccagagagcgtcaaatgaagagaggtaccgactcctgtcccacccaggacgcagccttcagcctccagccttctgaggcagagtaggcatttctgcacgtctgcaaaaggaagggagggaagcactccatcatctcactgggaagaacggcacgggcatacctgcagctactggggttccactgggcttgagggtcgatttttcaccttttgaaggacaagatgcattggaagatgttgctgcttctgctgttgtattacaatgctgaggcttctatgtgccacaggtggagcagggctgtgctcttccctgccgcccaccggccaaagaggtcctcatcactgccattgaacccagtcctgcagacctccctggaggaggtggagctgctctacgagttcctgctggccgaacttgagatcagccctgacctgcagatctccatcaaggacgaggagctggcctccttgcggaaggcctcagacttccgcaccgtctgcaacaacgtcatccccaagagcatcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaactcttaccgctgacacagagcagcagagatcaaacagtaaccccgatgctcttttctccttgtagtttcctggaagacacatctgattcatgccatcatgtgacctgggctggaagaaagggctggaatggtcattcaagacgcctccatgggcagaatggtttgcctatggcaggcagaattctgatatgcttcaacccagagcagtggccacacactcaagagtgagaacaggcgtgagccaccgtgcctggcccaggatctaaaaactttctaagtttcctccatcgttggcatcctcacagctatctccaatgtcactcaagagacatcaacagacatttaactgctgcagacttcattgctctgtcacctcaccttgaatctaacaaatcaaagtatttctgcaggtccaatggtctaaaatcaaatgcttgttaaatgactttttacaacaccccttactttcctaatccatttcaatcttattttttttattgtggtaaaaaacacatcaggtaaaatgtaccatcttaaccatttttaagcatatggtacagcagtgttaactccatgcatgttgtgaaacagacccccggaactttctcatcttgtaattctgaagttctatacccaccgaacaactcctcttttccccttccccctgcctgccccagctcttggcaccattattctgctttctgtttttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatgattgagttgctc

SEQ ID NO: 132263 - DNA, 1073 bp, Homo sapiens
  Payload ID: 5828
  Gene Symbol: FAM180A
  Gene Name: family with sequence similarity 180, member A
  Uniprot ID: Q6UWF9
  ENST ID: ENST00000415751
  CDS Start-End: 133-654
tttctgcacgtctgcaaaaggaagggagggaagcactccatcatctcactgggaagaacggcacgggcatacctgcagctactggggttccactgggcttgagggtcgatttttcaccttttgaaggacaagatgcattggaagatgttgctgcttctgctgttgtattacaatgctgaggcttctatgtgccacaggtggagcagggctgtgctcttccctgccgcccaccggccaaagaggtcctcatcactgccattgaacccagtcctgcagacctccctggaggaggtggagctgctctacgagttcctgctggccgaacttgagatcagccctgacctgcagatctccatcaaggacgaggagctggcctccttgcggaaggcctcagacttccgcaccgtctgcaacaacgtcatccccaagagcatcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaactcttaccgctgacacagagcagcagagatcaaacagtaaccccgatgctcttttctccttgtagtttcctggaagacacatctgattcatgccatcatgtgacctgggctggaagaaagggctggaatggtcattcaagacgcctccatgggcagaatggtttgcctatggcaggcagaattctgatatgcttcaacccagagcagtggccacacactcaagagtgagaacaggccgggcacagaggctcacgcctgtaatcccagcactttaggaggctgagacaggaggattatttgaggtcaggagttcaagaccagcct

SEQ ID NO: 132264 - DNA, 1534 bp, Homo sapiens
  Payload ID: 5828
  Gene Symbol: FAM180A
  Gene Name: family with sequence similarity 180, member A
  Uniprot ID: Q6UWF9
  ENST ID: ENST00000444083
  CDS Start-End: 40-561
tgggcttgagggtcgatttttcaccttttgaaggacaagatgcattggaagatgttgctgcttctgctgttgtattacaatgctgaggcttctatgtgccacaggtggagcagggctgtgctcttccctgccgcccaccggccaaagaggtcctcatcactgccattgaacccagtcctgcagacctccctggaggaggtggagctgctctacgagttcctgctggccgaacttgagatcagccctgacctgcagatctccatcaaggacgaggagctggcctccttgcggaaggcctcagacttccgcaccgtctgcaacaacgtcatccccaagagcatcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaactcttaccgctgacacagagcagcagagatcaaacagtaaccccgatgctcttttctccttgtagtttcctggaagacacatctgattcatgccatcatgtgacctgggctggaagaaagggctggaatggtcattcaagacgcctccatgggcagaatggtttgcctatggcaggcagaattctgatatgcttcaacccagagcgtgagccaccgtgcctggcccaggatctaaaaactttctaagtttcctccatcgttggcatcctcacagctatctccaatgtcactcaagagacatcaacagacatttaactgctgcagacttcattgctctgtcacctcaccttgaatctaacaaatcaaagtatttctgcaggtccaatggtctaaaatcaaatgcttgttaaatgactttttacaacaccccttactttcctaatccatttcaatcttattttttttattgtggtaaaaaacacatcaggtaaaatgtaccatcttaaccatttttaagcatatggtacagcagtgttaactccatgcatgttgtgaaacagacccccggaactttctcatcttgtaattctgaagttctatacccaccgaacaactcctcttttccccttccccctgcctgccccagctcttggcaccattattctgctttctgtttttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatgattg

SEQ ID NO: 132265 - DNA, 1388 bp, Homo sapiens
  Payload ID: 5829
  Gene Symbol: FAM180B
  Gene Name: family with sequence similarity 180, member B
  ENST ID: ENST00000538490
  CDS Start-End: 23-628
agctgaggtgtgtggcaggcagatgagggagcagagaactgctgaacagagtgagactcagaggacgtggttgagcatggctgcgaccctgcagttcctggtttgcctggtggtagccatttgtctcctctctggtgtgactacaacccagccccatgcagggcagcccatggacagcaccagcgtgggaggtggcctgcaggagccagaggccccggaagtgatgtttgagctgctctgggctgggctggagctggatgtcatggggcagctgcacatccaggatgaggaactagcgtccacacacccaggccgccgactcagactcctcctgcagcaccacgtgcccagtgacttggagggcactgagcagtggctgcagcagctccaggacctgcggaaggggcctcctcttagcacttgggactttgaacatctgctcctcacaggcctgtcctgcgtctaccggctccacgcagctagtgaggctgaggaacggggccgctgggcccaggtcttcgctctcctggcacaggaaacactctgggacctgtgcaaaggtttctgcccccaggaccggcccccttccctggggtcctgggcctccatccttgaccccttcccctgaccctcctcttttgttctttcacctgccattaccccctcccatctcctcctcaaccccccaggcagacccatcttgcgcaggggcttctgtctggcatctgattcttttcaccgtgttcagatctctgggcttggcttgcaccctggacaccccctctctgcttaccccgaccagatcttgtttcctagatcttgagaggctaagaacccaggctctgggtcgcaaggagtgcgcaaggagtgggcacagagctaagggcacgacttgcaggcagtgtgtgtgtgagtgtgtgtgtgtgtgtgtgtgtgtgtgtgtgtgtgtggagatcaggggtcagggttgagaagtgtgttcaagagatgctgaagggaagctgccccaagtaaggcctggtcagaccttccaactcctaccctggcagtctgtgacaggtcctgtggaattcacaggaatcctctaggtgctgagcatccccttttaggcacaaccaaggatttggggtctctgagcctccaagttcccatctgggttgggagaatcgactttttgagttctgtcagttggaagagtggagggaagcagggggagggaggaacattatctcttttggggtagggaggcaatatctcaacaagcgtcgggtgaatacctcagaggggggagtaaggctgggagaccaaggagagacaagcggaggtgggctggagcaggtgtggccctgattctgtgttgctcttctcataaaatgttctgtttcggc

SEQ ID NO: 132266 - DNA, 1816 bp, Homo sapiens
  Payload ID: 5830
  Gene Symbol: FAM181A
  Gene Name: family with sequence similarity 181, member A
  Uniprot ID: Q8N9Y4
  ENST ID: ENST00000267594
  CDS Start-End: 308-1372
agttgagatcaaacagacttttcattcctggttggtgcctgggagagtgacgaggcctatcagtactggaggacacagtcaagtgtttggtggaagaacagcccacattaagagctttggaaagactttcgtaagacaccaactcacctcccacggagtccacgggcctggtggggaggcttactactggctaagaaaggagagacagcttcatgagcgggcagtgcagaatgggccagcagggctgcaggtgccgtgggatctcaaggaagctgggagctgagctgagtggctctaaaatgtcttgatgcccttagaagagagaagatcttctggagagaggaatgatgcagcccccacaaatcacagaaggcctggggagaaaagggcgagcacagcaaagcaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttggagtttccata

SEQ ID NO: 132267 - DNA, 1652 bp, Homo sapiens
  Payload ID: 5830
  Gene Symbol: FAM181A
  Gene Name: family with sequence similarity 181, member A
  Uniprot ID: Q8N9Y4
  ENST ID: ENST00000557000
  CDS Start-End: 330-1208
cggggcctgtcccaggtctgcagtggggaacctgccgggccacgttggtggggcctgggccgcaccttcggtcagtgtggaggcccggtggctctggcccgactgggtggcgggtgtgggggcaggctggggcctgggggaggggcgaggtgccgtgggtggcggccgaggaggcatgaaattgctgcagatgcttcttcgggggaatccctgctgcccgcagcctgagatcagcccgcaaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttggagtttccata

SEQ ID NO: 132268 - DNA, 1162 bp, Homo sapiens
  Payload ID: 5830
  Gene Symbol: FAM181A
  Gene Name: family with sequence similarity 181, member A
  Uniprot ID: Q8N9Y4
  ENST ID: ENST00000556222
  CDS Start-End: 284-1162
tttgtatctggagaggcgctcctgattggcctgaggggccccccagctccggggagttgtcctccattcagcccactcaagggttgcacaactgcttccagccggacggagctcggccggctgcgccggggcctgtcccaggtctgcagtggggaacctgccgggccacgttggtggggcctgggccgcaccttcggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctag

SEQ ID NO: 132269 - DNA, 1072 bp, Homo sapiens
  Payload ID: 5830
  Gene Symbol: FAM181A
  Gene Name: family with sequence similarity 181, member A
  Uniprot ID: Q8N9Y4
  ENST ID: ENST00000557719
  CDS Start-End: 189-1067
aatcaaacccgagatgacagttgagatcaaacagacttttcattcctggttggtgcctgggagagtgacgaggcctatcagtactggaggacacagtcaaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacg

SEQ ID NO: 132270 - DNA, 842 bp, Homo sapiens
  Payload ID: 5830
  Gene Symbol: FAM181A
  Gene Name: family with sequence similarity 181, member A
  ENST ID: ENST00000554404
  CDS Start-End: 146-842
ttgcacaactgcttccagccggacggagctcggccggctgcgccggggcctgtcccaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctc

SEQ ID NO: 132271 - DNA, 1072 bp, Homo sapiens; identical to SEQ ID NO: 132269
  Payload ID: 5830
  Gene Symbol: FAM181A
  Gene Name: family with sequence similarity 181, member A
  Uniprot ID: Q8N9Y4
  ENST ID: ENST00000620448
  CDS Start-End: 189-1067

SEQ ID NO: 132272 - DNA, 1652 bp, Homo sapiens; identical to SEQ ID NO: 132267
  Payload ID: 5830
  Gene Symbol: FAM181A
  Gene Name: family with sequence similarity 181, member A
  Uniprot ID: Q8N9Y4
  ENST ID: ENST00000611800
  CDS Start-End: 330-1208

SEQ ID NO: 132273 - DNA, 1816 bp, Homo sapiens; identical to SEQ ID NO: 132266
  Payload ID: 5830
  Gene Symbol: FAM181A
  Gene Name: family with sequence similarity 181, member A
  Uniprot ID: Q8N9Y4
  ENST ID: ENST00000617881
  CDS Start-End: 308-1372

SEQ ID NO: 132274 - DNA, 842 bp, Homo sapiens; identical to SEQ ID NO: 132270
  Payload ID: 5830
  Gene Symbol: FAM181A
  Gene Name: family with sequence similarity 181, member A
  ENST ID: ENST00000629121
  CDS Start-End: 146-842

SEQ ID NO: 132275 - DNA, 1162 bp, Homo sapiens; identical to SEQ ID NO: 132268
  Payload ID: 5830
  Gene Symbol: FAM181A
  Gene Name: family with sequence similarity 181, member A
  Uniprot ID: Q8N9Y4
  ENST ID: ENST00000626058
  CDS Start-End: 284-1162

SEQ ID NO: 132276 - DNA, 3924 bp, Homo sapiens
  Payload ID: 5831
  Gene Symbol: FAM181B
  Gene Name: family with sequence similarity 181, member B
  Uniprot ID: A6NEQ2
  ENST ID: ENST00000329203
  CDS Start-End: 136-1416
agcgcagcgagccaggcccggaactagtaggctgcgccgcgcgcgccgcgccggggcgggagctgggtctgggcggcgggcaggagctggcgggggcgcacgggcagcgctgcggacagcccgggagccgcggcgatggcggtgcaggcggcgctcctcagcacgcaccctttcgtgcccttcggcttcgggggctccccggacgggctagggggcgccttcggagccctggacaagggctgctgtttcgaggacgatgagaccggggctccggcgggtgcgctgctgtcgggagccgaaggaggggacgtgcgcgaggccacccgcgatctactcagcttcattgactcggcgtccagcaacatcaagctggcgctggacaagccgggcaagtcgaagcggaaggtgaaccaccgcaagtacctgcagaagcagatcaagcgctgcagcggcctcatgggcgccgcgccccccggcccgccctccccgagcgccgccgacacgccagccaaacggccgctggccgcccctagcgccccgacagtcgcggccccggcccacggcaaggctgccccccggcgggaggcgtcgcaggccgccgcggccgccagcttgcaaagccgaagtctggccgcgctcttcgactcgctgcgccacgtccccgggggtgccgagccggcggggggtgaggtggctgcgccggcggccgggctaggaggtgcgggcactgggggcgcgggaggggacgtggcaggccccgcgggggccacggcgatcccaggggccaggaaggtcccgctgcgggcacgcaatctgcctccgtccttcttcacggagccgtcccgggcaggcggcggcgggtgtggcccgtcggggccggacgtgagcttgggcgacctggagaagggcgcggaggccgtggagttctttgagctgctggggcccgactacggcgccggcacggaggcggcagtcttgcttgccgccgagcctctcgacgtgttccccgccggagcctccgtactgcggggacccccggagctggagcccggcctctttgagccgccgccggcagtggtgggaaacctactgtaccccgagccctggagcgtcccgggctgctccccgaccaaaaagagccccctgactgccccccgcggcggcttgaccttgaacgagcccttgagccccctgtaccccgccgctgcggattctcccggcggggaggacgggcggggccatttggcctctttcgcccccttctttccagactgcgccctgcccccgccgccgccgccccatcaggtgtcctacgattacagcgcgggctacagccgcaccgcctattccagcctttggagatccgacggggtttgggaaggggcgccgggggaggagggggcgcaccgggactgacttcgaggcacgcttcccttcattagagacggctgtggagagcgccgcgcctccgtgggtttctcctaaatctgaagaacgatgggaaaatgcacgtggagatgaaaccagatttttaaaaattcaattaataaaagcaacttcagaaaaaagagatgaagacgagttggggattgtttaatcacaacctcaagtgttaaaacaaaaacaaacaaacacgtttgtaggttcttactggaccagaggagtcaagaaaccaagatggtttggggtatggggtggggacggcaaaaggggtaagagctggcttctgtagccacctgtcccttctatttttcagcgaaggtcagtgtatttagtgtaattaccccttctaaacagtgtcctagtccctcccttccctctccttgagtgcattttgaattaaagcctatattgaaaagaatggaggtgagacttactgatttgggtgttttcttacaggacggttttccgtctggtcgcttagctttgttaggtgagcctgtggctgagggaggaggccggtggtccactgctgacctcctgtgcttgtccttgggtagggttctcttctgtcacggtttaactcttttttctgcccgcttcctgcttccatctccctccacccttatcacagtcccagtgcttactttccttctttctttgcctggcctctcattattctatttctttcggccggcttttcttgcacatctcttttgtaggagacttaaatttggcaaacctgggttccatttctctcctgtcttttccccattttccagccactttgggagggagagggtgggcaaactgtaacctctttgtatcaattttcgtgatctgagagggtgaagacggtaatgttcttctactcacttcacaactggttgggtagctcagagggaaataagtaaaatgtcttgaggctgtggcagtgcttgattggttctgctgtgtatatataaatggtttctacacacggaaacagagttgtgagtcccatgccttttttggcggggggctatctacttgcctggtgattgccctttcccttacaagctgtacatcctctttaccatccctccttctctccttccacagctccccttccacctctgttggtttctgcctccctttgtttcctcagtccttatacccacactctccccacggaagggcataaagaaaggtgtgaagtttccaaaggaatttctgttccctgaatagcaggtctgatgaatggaatctgaaggggctctgcagggaggagtatgatctgttgtccgagggagatttggggaaaaagaaatatttttaccagccatgaatgtggcagagaggacacatggcaccaataggttggttaaggggcaggggaggaaagactggtgggaagtgagcagctggagggaaaagaggagcccttggtgctgtagaactgcggggagaaaggcatgaagagagcaacgcccagaacatctgagtgagaggctgccttctgatgatgctgcaaaggagagctgcttggcttcaaggcacccaggattgattgcaggaatatctggatgtgagttagttgaaaaccgagtgttaccgcaagaggtgtaaaaatccaggttcatgtttgcacacatcaaaagtattgtgatattttcataaaagaatttctggaaaaaatgagtattaaccaatggtagatgcaactttaaatgctatcagtaagtcattttcttctgaataaagcctttcttaagaaagcaccacaggaaatagaacgagtactgttaatgatgaaaagaacttttgcaactccagaaagctaatgtctattggatttcttccaaagtggttaaaggtgattaattccattgtgctaacagaatattacttaataacgatttaatttgtctaaactgttgtgaatacaatccaggatacacttgcacagtaggaaaacattaataaccctgtgactgttactaagactatagtgtcattgtaatgtttcttaattctcctctcctttcttacctagtgtagtaaaacaggttatctctctcctactgttttgcttgctatacgtttaattaataataatatcaacattgtttccgcatcccaggcatttaagctaactcactgagcctcttaatattgccatgatgtaggtgcttgatactgtttggatctgtgtccctagccaaatgtcatctctaattgtaatccccacatgtcgagggaggtcctagtggaaggtgattggatcatgggggtggtttcctccatgctgttcttgtgatagtgagggagttctcatgagatctgatggttataaagtgtggcacttccttgctatctctctctcctgccaccatgtaagacgtgccttcctgctgcttcaccttctgccatgattgtaagtttcatgaggcctcccagccatgtggaactgtgagtcaattaaacctctttcatttataaatt

SEQ ID NO: 132277 - DNA, 1681 bp, Homo sapiens
  Payload ID: 5832
  Gene Symbol: FAM182B
  Gene Name: family with sequence similarity 182, member B
  Uniprot ID: Q5T319
  ENST ID: ENST00000376403
  CDS Start-End: 380-838
gacctctcctcggggtcgacgggaaggtctccggatgccaggactcgcaaagggccgaccagaatgaggaaatcccaggcggagtccgggggaggcagcacggcatcccagcctcagggctgcccggacggtgttggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtgacggggttcgcagcgccaggggacccagcagagcccgagcccgggcatcccgcatctccagcagcatcgcaggtaggcctggtgctggtgaagtggcggccagtgcacaaggcctacgacccagtcccagaggccagcccattgtcagctaacttcaggaaccccgggccagctgaggccccgggccccatgggcaagacaaagggcagagggtccgcaggcggggccgagtgcaggcagtgcaggcctggctccaccgccgcggagctcgcagggcgcagcaggcatcgggcagtgaccagggcttccagaggaggctgtgcacccctgcaaaggctcctgccctgcgtccagcctatccgcggggactccacgtgcaccccctcctcattgtccttgtctagggccgcggcggcaaggtccttgctcccatggcgtgactccagggtgcaggagcctgggctgagcaggtggagtagggtgagctccgccaagaacccagcgagagtggcgccccagggcggcacaggaggccgcatttaacatgtcaatcatctgaaagattttatggcatcttttttttgacatcttataatatctataatgtttattatatcttgtgatataattattaacaccacttcagtgtgattattatgattatttttataccaacacatcttcaattattaatattcccagttgctagagaaaactgaaaactactagttttgaaagcctcacttctgccaatggaagcacattccagcatgtcgccaacgcaatccactttccaccactttcacaaaaaacgttactgcacaattatactatcctaccctta

SEQ ID NO: 132278 - DNA, 456 bp, Homo sapiens
  Payload ID: 5832
  Gene Symbol: FAM182B
  Gene Name: family with sequence similarity 182, member B
  ENST ID: ENST00000376404
  CDS Start-End: 1-456
ttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 132279 - DNA, 733 bp, Homo sapiens
  Payload ID: 5832
  Gene Symbol: FAM182B
  Gene Name: family with sequence similarity 182, member B
  ENST ID: ENST00000584071
  CDS Start-End: 413-733
tgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaagtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 132280 - DNA, 488 bp, Homo sapiens
  Payload ID: 5833
  Gene Symbol: FAM183A
  Gene Name: family with sequence similarity 183, member A
  Uniprot ID: A6NL82
  ENST ID: ENST00000335282
  CDS Start-End: 1-405
atggcgggacacccaaaagagaaggtgattccagatgaggtccatcagaaccagatcttgcgggaactgtacctcaaggagctacgaacccagaaactctacacgcagtatcacgtgaatcccctccgcaagattcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaa

SEQ ID NO: 132281 - DNA, 530 bp, Homo sapiens
  Payload ID: 5833
  Gene Symbol: FAM183A
  Gene Name: family with sequence similarity 183, member A
  ENST ID: ENST00000410025
  CDS Start-End: 36-212
ggcccaggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagagtgagagttcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaa

SEQ ID NO: 132282 - DNA, 500 bp, Homo sapiens
  Payload ID: 5833
  Gene Symbol: FAM183A
  Gene Name: family with sequence similarity 183, member A
  ENST ID: ENST00000410048
  CDS Start-End: 97-417
cagccagcctgcatgaggttctctacgtttgagactggcttctccacggaacttggtctgtagccacagagcaaactgcagggccattgacagagaatgaagaggagagtgaagagtggaacacatctaatgtgttctctggaggttcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaa

SEQ ID NO: 132283 - DNA, 448 bp, Homo sapiens
  Payload ID: 5833
  Gene Symbol: FAM183A
  Gene Name: family with sequence similarity 183, member A
  ENST ID: ENST00000409396
  CDS Start-End: 30-448
ggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagattcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttggtaagcgtggctccttcctcaggaaatacgaggaaacacagcagcaatatcaacccagaacgccatgaccgcaggctgaatcacttcagggtctgcagtgacatcactctgtacaaggctaa

SEQ ID NO: 132284 - DNA, 3700 bp, Homo sapiens
  Payload ID: 5834
  Gene Symbol: FAM184A
  Gene Name: family with sequence similarity 184, member A
  Uniprot ID: Q8NB25
  ENST ID: ENST00000352896
  CDS Start-End: 512-3427
aaatctcacagtgctcatttttaaaagggtacacaaaaaaatctcaattccaaagaatttggatcagccaagagaaggcatgggaaaatatcaaatgtttgtatgattacctgggcaaccttttctgtgctatgtaaatgtgtaatgactaatcaaccaggacggccaagggatttgtttctagagataggcaattttcatttgtgcctgtgattggctcagctctgcgtgtgaagagggaaaaggcttccgtttatttagcataatgatggaccaaaacaaaagaagaaatcatttcactcatgcttaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataagattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaa

SEQ ID NO: 132285 - DNA, 4141 bp, Homo sapiens
  Payload ID: 5834
  Gene Symbol: FAM184A
  Gene Name: family with sequence similarity 184, member A
  Uniprot ID: Q8NB25
  ENST ID: ENST00000338891
  CDS Start-End: 445-3867
ggtaacggcggctcccgcgtcctcctccatgtccccgcctatccccgccgcagcccgccccgtctcctcctccctccgcagcctcgccgagtcctcggtgcgggctgcgagcgggacccgcggagctgcgctgtcctcgacgcctccgccaggcgcgggccgaggagcctccaagagctggcccggcccccggccgccgccgcccaaccccgggcatctgccccgcgccgttgtccccgcggcttcgggccggcgggaccgccccgtcccttccaggggtgacccgggggtcgcgggtgggacggcgcctgcggccgagtctggggggcgccgggtgtcgggtcgggaagcggccgccgcgactcttgcctcccgggcgtcgttgctccacgggcctgcctccacccgcggggacaggtgccccggctggggtctgttgggaagatggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaac

SEQ ID NO: 132286 - DNA, 679 bp, Homo sapiens
  Payload ID: 5834
  Gene Symbol: FAM184A
  Gene Name: family with sequence similarity 184, member A
  ENST ID: ENST00000368472
  CDS Start-End: 1-498
atgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaaggtatcagtaagatgcatgtgcatgagctcaaggaacatgactactggagtttccattacacattgttgcgtgccttgtaattttccccaaagacgtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactata

SEQ ID NO: 132287 - DNA, 3392 bp, Homo sapiens
  Payload ID: 5834
  Gene Symbol: FAM184A
  Gene Name: family with sequence similarity 184, member A
  ENST ID: ENST00000368475
  CDS Start-End: 312-3122
tttgtgcctgtgattggctcagctctgcgtgtgaagagggaaaaggcttccgtttatttagcataatgatggaccaaaacaaaagaagaaatcatttcactcatgcttaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataagattagaagaaatggaagaaaaatatctaatgagagaatcaaaaccagaagatatacagatgattacagaattaaaagccatgcttacagaaagagaccagatcataaagaaactaattcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatc

SEQ ID NO: 132288 - DNA, 542 bp, Homo sapiens
  Payload ID: 5834
  Gene Symbol: FAM184A
  Gene Name: family with sequence similarity 184, member A
  ENST ID: ENST00000448815
  CDS Start-End: 1-425
ctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagaggcaagaattctttagacctgttgcctatgttatagattttaataataataacttattctggtgacattgtataggtaggtaagtctcagtaaaggtaacatatctagaataaaaataatttaaaaactttaa

SEQ ID NO: 132289 - DNA, 1555 bp, Homo sapiens
  Payload ID: 5834
  Gene Symbol: FAM184A
  Gene Name: family with sequence similarity 184, member A
  ENST ID: ENST00000475529
  CDS Start-End: 1-1115
cattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgaggtatcagtaagatgcatgtgcatgagctcaaggaacatgactactggagtttccattacacattgttgcgtgccttgtaattttccccaaagacgtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaa

SEQ ID NO: 132290 - DNA, 1147 bp, Homo sapiens
  Payload ID: 5834
  Gene Symbol: FAM184A
  Gene Name: family with sequence similarity 184, member A
  ENST ID: ENST00000521043
  CDS Start-End: 1-807
cataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaacaatgctttttatttttttctacgtttgctttaatttttaaatattttttaattccaggtaagactt

SEQ ID NO: 132291 - DNA, 497 bp, Homo sapiens
  Payload ID: 5834
  Gene Symbol: FAM184A
  Gene Name: family with sequence similarity 184, member A
  ENST ID: ENST00000481884
  CDS Start-End: 1-224
tcaatcgagaaactaacttcaacaaagtgtttaactcaagtcctactgttggtgttattaatccattggctaagggactatcctcacatgtattatttttaatgcagcaaaagaagaagaatgataaatcaccaacaaacagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaa

SEQ ID NO: 132292 - DNA, 2721 bp, Homo sapiens
  Payload ID: 5834
  Gene Symbol: FAM184A
  Gene Name: family with sequence similarity 184, member A
  ENST ID: ENST00000522284
  CDS Start-End: 377-1966
acttgtgtgccattggaaggaaggtcagggcagggaatcctcgctacttcactactcatgtctctggattgggcttgcctctcttcttggggaagagccacttcttggggccctgcacacacgaggacgcatgtggaaagggtctgtaaatcgacacccgttctgctaaccgaaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagcttctggtagcaccaggcattcttggcattcggcaacataatttccatctctgcctatcttcacatcttaaaaggataccaggcatattggaacaagggctcattctactccagtttgacatcatcttaacttaatacatctgtactgactgtatttccaaataaagtcacattctgaggtattgggagggtaggacttcggtatatctttttggggacccagttcaaccgataacaattggaacgtgcaattcttttactagtaagaggtagaactctcatatacagcaactaagtgcttctctgtgtctgcagatttcagaaagactctgccttttttcttccactcttatgaagcacagcaaagatttagattgtcttagatagtagagaaaaagaatccataaaactgggtgtatagtacccaggaagttcttaatcttttccttcagagagatggtttagagtataggctctgaagtcaggttggttgtatgtaaattctgaatccaccacatagtgtgtagctttgtgcaaagcctcaccttccacatctgcacaatgaaggagaggtggggggtaataacactcttcacagcactgttgtaataattaaatgagatgaaccatttatagcacagtgcttagcaaaatagtaaacactcagtaaatactgccttttactaatattatttcagattttcttttttagttcagaattggtgacatttcaaaagcatataaacaaggacactttagtgaatttaccttgtgtgtggggcatacataattctatttatattttatctatgatatattctgtgtgcattgaatatttaccttccattttgaattatgtgacaataaattacttcattttcctcgaatca

SEQ ID NO: 132293 - DNA, 3244 bp, Homo sapiens
  Payload ID: 5834
  Gene Symbol: FAM184A
  Gene Name: family with sequence similarity 184, member A
  Uniprot ID: Q8NB25
  ENST ID: ENST00000521531
  CDS Start-End: 74-3244
cccgggcgtcgttgctccacgggcctgcctccacccgcggggacaggtgccccggctggggtctgttgggaagatggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataagattagaagaaatggaagaaaaatatctaatgagagaatcaaaaccagaagatatacagatgattacagaattaaaagccatgcttacagaaagagaccagatcataaagaaactaattcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctga

SEQ ID NO: 132294 - DNA, 485 bp, Homo sapiens
  Payload ID: 5834
  Gene Symbol: FAM184A
  Gene Name: family with sequence similarity 184, member A
  ENST ID: ENST00000517987
  CDS Start-End: 1-211
gttttatcagctggaattagtcaatcgagaaactaacttcaacaaagtgtttaactcaagtcctactgttggtgttattaatccattggctaagcaaaagaagaagaatgataaatcaccaacaaacagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaac

SEQ ID NO: 132295 - DNA, 1251 bp, Homo sapiens
  Payload ID: 5834
  Gene Symbol: FAM184A
  Gene Name: family with sequence similarity 184, member A
  ENST ID: ENST00000617072
  CDS Start-End: 8-814
tgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgaggtatcagtaagatgcatgtgcatgagctcaaggaacatgactactggagtttccattacacattgttgcgtgccttgtaattttccccaaagacgtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatc

SEQ ID NO: 132296 - DNA, 4048 bp, Homo sapiens
  Payload ID: 5834
  Gene Symbol: FAM184A
  Gene Name: family with sequence similarity 184, member A
  ENST ID: ENST00000621231
  CDS Start-End: 478-3774
ggtgcgggctgcgagcgggacccgcggagctgcgctgtcctcgacgcctccgccaggcgcgggccgaggagcctccaagagctggcccggcccccggccgccgccgcccaaccccgggcatctgccccgcgccgttgtccccgcggcttcgggccggcgggaccgccccgtcccttccaggggtgacccgggggtcgcgggtgggacggcgcctgcggccgagtctggggggcgccgggtgtcgggtcgggaagcggccgccgcgactcttgcctcccgggcgtcgttgctccacgggcctgcctccacccgcggggacaggtgccccggctggggtctgttgggaagatggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaaactggttaatttacaaaagaaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaac

SEQ ID NO: 132297 - DNA, 6622 bp, Homo sapiens
  Payload ID: 5835
  Gene Symbol: FAM184B
  Gene Name: family with sequence similarity 184, member B
  Uniprot ID: Q9ULE4
  ENST ID: ENST00000265018
  CDS Start-End: 214-3396
gaaccagcaggagaggaaaaagggtgggcgcgcgggtgggcccgggaggcggagaccttcgggaagctggggccacgcggcggtgcaggcgacgggactgcagtgccacctctcccgagaaacccacacgctcgcacgcccgcgcgcgcacgcacgtgcacacggtgggcagggagaaaacgagagagtctgagtgctgggcgcgttttagcgatggcttctgctctcaacagcaaaattaacccgcccggcacttgccagggctccaaagccgacggtggcgccggctggagaatggactgtgatccccagatgcacgtgaaaatgtgcaagaagatcgcccagctcaccaaggtgatttatgccctgaacacccgccaggatgaggctgaggccagcatggaggcgctgcgggaagcgcaccaggaggagctccagaatgcggtggcagagaccaaggccaggctcctgcaggaacagggctgcgcagaggaggaagcccttctacagcgcatccaggccctggagagcgccctggagctgcaaaagaggctgacggaggaggcgctggctgagtcggcctcgtgcaggctggagacgaaggagagagagctgagggtggaggcagagcacgccgagcgagtcctcacgctctccagggaaatgctggagctcaaggctgactacgagaggaggctccagcacctgacgagccacgaggctaccccgcagggccggctgccccaggagagccctgaaaccaagtcggagccaggccagggcccggagatgcaggaggtcctgctagaggtgcagcggctgcgagtggagaaccagcagctgagcaaggactacgcccgcaaggccgaggagctgcaggccacctacgagagggaaaacgaggccatccggcaggccatgcagcagtcggtgagccaggccctgtggcagtggcaggagaaggagtcggacctccgcaagaacttccaggtccaggagtcagccctgcaggctcaggtccggaagctggaaggagacctggagcacagaggccgcaagataagtgacctgaagaagtacgcccagaagctgaaggagaggattcaggacctggatgtgcagcttaaggaggctcgacaggagaattcagagttgaaaggcactgcaaaaaaacttggggagaagctggctgttgccaaagacagaatgatgctgcaggagtgtcgtgggacacagcagacagatgccatgaagactgagttagtttcagagaacaaagtcctgcgggaagagaatgacttggaagccggcaatcttcatcctcagcaggatcaaagctgtctcaaggagtgcccttgcatgaaaggaggcacagatatgcagaccaagaaagaggcaagtgctgagacagaatatatgaagcaacaatatgaagaagaccttcgtaaaatcaaacatcagacagaagaggagaagaaacatctcaaagaccagctagtgaagcgactagaagacttggtaaagaagcacaccgtggaaatcaaatccgttcgctcgtccgtggaggctgaaagaaagaaactgcagagggaagtagaagcacagttggaggaagtgaggaagaaatcagaaaaggagataaagcagctggaagaagagaaagcagccctcaatgtgaagcttcagaattctctgcttgaggttttaaggctggaagaatttatccaacaaaataagacacgccccacaggagctgaggaaagtccccaggaattaggccgccagcactgcagcattctggagacccaggatccatgcttgaagctggatgaaacttcgccgagaggagaggagtatcaagataagttagcagctgaagaaggaaccagcagtgatgaagaagaaaggaccaaagtgcttctcaaggagggaagtgacccacaacctccactgggctctttgttgaaggagaaaacatccaaaatccagcgtctagaggaggactggcaaagccagaaggccaaattgcaagcccaggtctcacagatgcagcaggctctggagcagtgcaccagcaactacagggaggacctgcaggcactcaagcagctctcggacctggagagggagaagctgcagcgtgagctccaggagaccactcagcagaaccacgccatgaaagcccagctcgaggcttcccaccagagagccctgcgcatgctggagaaggccagacatcaggaactcaaggccacagaggaacgcttgaagaaggaatccagccacagcctccagatccaacaccagacacaccgactggagctccaggccttggaggaaaaggccaggcaagagctgcaggaggagcgtgagaggatgcaggcacagcaggccctgctgctagagtcgctcagacaggagctgtcggagcagcaagctgcctgttctgggcaccagaaggacttggaggcactgcaggccgagctgagggctctgggcagacagcaagccagcagccagtgtccaggagacagcaaggatcacataatcgccacagaggagcggggcggcccgggccaggccggctccccaccgggcgctgctgggcagggttccggcgagggatgcgggctctgggaggagaacgcgcagctccaggacgcggtgcggcggctgcgcgcggaggtggagcagcatcagcaggaggcgcagaagctccgagaccagcgcaggttcctggaggagactcagcaagcccagcgggccagggaggtggagacactgcgccaggaacaccggaaggagatgcaggccatggtggcagatttcagtagtgcccaggcccagctccaggcccggctggctgccctggaagccgaactgaaagattccggagagaagccagggaagggagcgtccaggcccgaggaccttcagctcattggccgcctgcagacccgcctgaaggagagagaggacatcatcaagcagctcacggaagagagaagatttcactacgcagcattccccagtgccatgtcccaccggaatcggtctttctctttcaatcctcacccgggatatttgaccccttccatgaagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggaccccagatggtgaaacggcccaagccaaagaagtccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaaaaaaaaaaaaaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactttgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttaatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagat

SEQ ID NO: 132298 - DNA, 1446 bp, Homo sapiens
  Payload ID: 5836
  Gene Symbol: FAM185A
  Gene Name: family with sequence similarity 185, member A
  Uniprot ID: Q8N0U4
  ENST ID: ENST00000409231
  CDS Start-End: 181-1008
ggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggggcgccgaactctgaaggagtggacactgcagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaatttagcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagagg

SEQ ID NO: 132299 - DNA, 1179 bp, Homo sapiens
  Payload ID: 5836
  Gene Symbol: FAM185A
  Gene Name: family with sequence similarity 185, member A
  Uniprot ID: Q8N0U4
  ENST ID: ENST00000413034
  CDS Start-End: 1-1179
atgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggggcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaa

SEQ ID NO: 132300 - DNA, 1958 bp, Homo sapiens
  Payload ID: 5836
  Gene Symbol: FAM185A
  Gene Name: family with sequence similarity 185, member A
  ENST ID: ENST00000420217
  CDS Start-End: 199-414
atcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggggcgccgaactctgaaggagtggacactgcaggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaatttagcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagaggccacccacatgccttctcatgttgcccctccatcttcaagccagcagtgatgcgctgagttcttctcatgctttgaatatctgacttcttctgcagccagctggaagaatatatacttttaaagggctcacttgattaggtcaggcccacccaggataacctttgttttgccatataatgtaacattcataggagtgatggcccatcacattcagttttcactcccactcaaggaaaggagattatacaaaggcatccatcatgtggggacaattagcttagaattctttataatgtagctctcacatgacaggttttctacttagtaccttttatggcatcaatgtaaatttaagctgtaaataaaaaacaaatatgtgaagc

SEQ ID NO: 132301 - DNA, 755 bp, Homo sapiens
  Payload ID: 5836
  Gene Symbol: FAM185A
  Gene Name: family with sequence similarity 185, member A
  ENST ID: ENST00000418198
  CDS Start-End: 172-755
ggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggggcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggtttagatatcaagtcatcagggtctggctgtgtaaaagttcaaagtattgagggtgataattgcaaaattgaaacagagcatgggactagtatcttgcagtctgttaagggtcaaaaattgcatgttcaaac

SEQ ID NO: 132302 - DNA, 2217 bp, Homo sapiens
  Payload ID: 5836
  Gene Symbol: FAM185A
  Gene Name: family with sequence similarity 185, member A
  Uniprot ID: Q8N0U4
  ENST ID: ENST00000442873
  CDS Start-End: 238-672
cttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggggcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaatttagcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagaggccacccacatgccttctcatgttgcccctccatcttcaagccagcagtgatgcgctgagttcttctcatgctttgaatatctgacttcttctgcagccagctggaagaatatatacttttaaagggctcacttgattaggtcaggcccacccaggataacctttgttttgccatataatgtaacattcataggagtgatggcccatcacattcagttttcactcccactcaaggaaaggagattatacaaaggcatccatcatgtggggacaattagcttagaattctttataatgtagctctcacatgacaggttttctacttagtaccttttatggcatcaatgtaaatttaagctgtaaataaaaaacaaatatgtgaagca

SEQ ID NO: 132303 - DNA, 7127 bp, Homo sapiens
  Payload ID: 5837
  Gene Symbol: FAM186A
  Gene Name: family with sequence similarity 186, member A
  Uniprot ID: A6NE01
  ENST ID: ENST00000327337
  CDS Start-End: 1-7056
atgttcttcaaaatgaaaaatgagatagacaatgaccctgaatcagaaaaatgcatcaaggattccaccatcatgagaagagagccccaaaatatccttagtcctttgatgctccctaaccttgagatcccattctcagtaaaggatatcatctctaggattgagcgcgcacagctccatcgagccagagaggacattgatatgcagctgagtgaaataatgaacaatgtgcatcggataatgactcgctatactcttgtttttaactcgtcctctgaaaggaatgtctcccttacagaacataagaaaaaacagagaaccaattttcttgagaaaatggctacttacgctaagactattgaaataagagaaaagactcttgccaacattctggcctggttggaagaatggaatgatgttttgtctgagatgactctaatggatgttgatgaacaccaccactggatagcacaaatggagttgttaccggacacgttaaaagctattgagaacaatgtcaagatactaagcagatttagtacatctttcctcgacgaaaagaagaaacaaaagaaaaaaatattatctagaggtactctatggaaatcttggaaagaaagagttataaaacgaccttcaacagcccgtgctttaagaccagatcagatgattagtgatcaacttgcaacaaatacaaaggtttcagaaatccaaggtatgctacaggaactcataggcaccacaatgttcagtacattggaaaacaatgctattaaatatatatcatcaacaatagtaaacctttctacagctttgagtatgctaaatgatgaattaaaatgtgttaacttccaaagttccactgtgtatgcacatgagacaagtgaagcagaaaaggagctctctctgaagataatacgagatctcagtaacgaaaatgaaatgcttcagcagaaacttcaagatgcagaagaaaaatgtgaacaacttattcgatccaaaattgttatagaacaactatatgcaaaattgtccacatcatcaaccttgaaagtgttacctggaccttctccacagtcatccagggcgataatcaaagttggtgatactgaggacaatatggacaatattttagacaaggaacttgaaaatattgtagatgaagtccaaagaaaagagaccaaggactctgggataaaatgggactccactatttcatatacagcccaagctgaaagaactccagatttaactgaactacgacagcaacctgttgcttctgaagatatttccgaagacagcactaaagataacgtatcattgaagaaaggtgatttctatcaggaagatgagactgatgagtatcaatcatggaaaagaagccacaaaaaagccacatatgtatatgagacctctggaccaaatctgagtgataataaaagtggacagaaagtctcagaggccaaacctagtcaatactatgagctacaagtactgaaaaagaaaagaaaagaaatgaaatccttttctgaagataaatcaaagtcacccactgaagcaaaaagaaaacatctctctttaactgaaacaaagagccaaggtggcaaaagtggaacaagtatgatgatgttggagcaatttaggaaggtcaaacgtgaatctccatttgacaaacgtccaactgcagcagagattaaagtggaacccaccactgagtcattggacaaagagggcaaaggtgaaattagaagcctagtggagccactcagtatgatccaatttgatgatactgctgagccacagaaaggaaaaataaaaggaaagaaacaccatatctcttcaggaactatcacaagcaaagaagaaaaaactgaagagaaggaagagttgaccaaacaagtcaagtctcatcaacttgttaaatcactctcaagagtggctaaagagacttcagaatctaccagagttctagaaagtccagatggcaaaagtgaacagagtaacctcgaagaatttcaggaagccataatggctttcctaaaacagaaaattgataacataggaaaggcttttgacaaaaagactgttccgaaggaagaggagttattaaaaagagcagaagctgaaaaattaggaatcataaaggcaaaaatggaggaatatttccaaaaagtggctgaaactgtgactaaaatcttgagaaaatacaaagatacaaaaaaggaagaacaagttggagagaaacctataaaacaaaaaaaggtagtctcatttatgccaggattgcattttcagaagtcaccaattagtgcaaaatctgaaagcagtaccctcctctcatatgagagcacagatccagtaattaacaatttaatacaaatgatcttggctgaaatagaaagtgaaagagatattccaacagtctcaacagtacagaaagaccacaaggagaaggaaaaacaaaggcaggagcaatatttgcaagagggtcaagaacaaatgtctggcatgagtctcaaacagcagttgctgggagaaagaaatctcttgaaggagcactatgagaagataagtgagaattgggaagaaaaaaaggcatggctccagatgaaggagggaaagcaagaacaacagagccagaaacagtggcaggaagaagagatgtggaaggaagagcaaaaacaggcaactccaaagcaggctgagcaagaggaaaagcaaaagcaaagaggacaggaggaagaagagcttccaaagtcaagcctgcagcggctggaagaagggacccaaaaaatgaaaacacaagggttgctcttggaaaaggagaatggacagatgaggcagattcagaaggaagcgaaacatttggggccacacaggagaagggagaaagggaaggaaaagcagaagccagagagagggctagaggacctcgaaaggcagatcaaaacaaaggatcagatgcagatgaaggaaacacaacctaaagagctagaaaaaatggtcatccaaactccaatgacattatctcccaggtggaagagtgtattgaaagatgtacagcggtcatatgaaggaaaagagtttcagaggaatctgaagacattagagaaccttcctgatgaaaaggagcccatatcaatcacacctcccccctccctacaatactccctgcctggagctcttcctatttctggccagcctctcactaaatgcattcatctcacacctcagcaggcccaggaagtggggatcacactcactcctcagcaggcccaggctcaggggatcacgctcacccttcagcaggcccaggaactagggatccctctcacccctcagcaggcccaggccctggagatccttttcacccctcagcaggcgcaggccctggggatccctctcacccctcagcagacccaggttcaagggatcactctcacccctcagcaggaccaggccccggggatctctctcaccactcagcaggctcagaaactagggatccctcttacccctcagcaggcccaggccctggggatccctctcacccctcagcaggctcaggaattggggatccctctcacccctcagcaggcccaggccctgagggtctctctcacccctcagcaggctcaggaattggggatccctctcacccctcagcaggcccaggccctggggatcactctaacccttcagcaggcccagcaattggggatccctctcacccctcagcaggcgcaggctctcggaatcactctcacccctaagcaggttcaggaactggggatccctcttactcctcagcaggcccaggccctggggatcactctcacccctaagcaggctcaggaattggggatccctctcaaccctcagcaggcccagaccctggggatccctctcacccctaagcaggcacaggctctggggatccctttcacccctcagcaggcgcaggccctggggatccctctcacccctcagcaggcgcagactcaggagatcactctcacccctcagcaggcccaggccttggggatgcctctcaccactcagcaggctcaggaactggggatccctctcacccctcagcacgctcaggccttggggatgcctctcaccactcagcaggctcaggaactggggatccctctcacccctcagcaggctcaggccttggggatgcctctcaccactcagcaggctcaggaactggggatccctctcacccctcagcaggctcaggaattggggatccctttcacccctcagcaggcacaggctcaggagatcactctcacccctcagcaggcccaggccctggggatgcctctcaccgctcagcaggctcaggagctggggatcactctcacccctcagcaggctcaggaattggggatccctctcacccctcagcaggcccaggccctggggatccctctcatccctccgcaggctcaggaattggggatccctctcacccctcagcaggcccaggccctggggatccttctcatccctccgcaggctcaggaattggggatccctctcacccctcagcaggcccaggccctggggatccctctgatccctccgcaggctcaggaattggggatccctctcacccctcagcaggtccaggccctggggatccctctcatccctccgcaggctcaggaattggagatccctctcacccctcagcaggcccaggccctggggatccctctcacccctcagcaggcgcaggaactggggatccctctcacccctcagcaggcgcaggaactggggatccctctcacccctcagcaggcgcaggctcaggggatccctctcacccctcagcaggcccaggctctggggatctctctcacccctcagcaggcgcaggctcaggggatcactctcacccctcagcaggcccaggcactgggagtccccatcaccccagtaaatgcctgggtgtcagctgtcactcttacctctgagcaaacccacgctttggagtcccctatgaacttagaacaggctcaagaacagttattgaagttaggggttcctctcaccttagataaagcccataccttgggatcgcccctcacccttaagcaagtccagtggtcccatagaccatttcagaaatcgaaggcttctctccccactgggcaatccatcatatcaagattgtctccaagtcttaggctgtccctggcatcatcagctcctactgctgagaagtcctctatattcggggtctcttctactcctttgcagatatcaagggttcccctcaaccaaggcccctttgcccctgggaagcccctagaaatggggattctttctgagcctgggaagcttggggcaccacagactcttcgttcctctggacagaccctggtatacggaggtcaatccacttctgcgcagttcccggcaccacaggcccctccctcccctgggcagctcccaatatctcgggcccctcccactccagggcagccctttatagctggagttccacccacttctggacagattccaagtctctgggctcctctttctcctgggcagcccttagttcctgaagcctcttccatccctggggacctcctggaatctggacccttaaccttctctgagcagctccaggaattccagcctcctgccactgctgagcaatctccctatctgcaggctccttctacccctgggcagcatctggcaacatggacccttcctgggcgagcttcttcattatggatccctcccacctctagacatcctcccacactatggccgtccccagcccctggaaagccccagaaaagttggtccccttctgttgctaagaaaagattggcaattatttcttctctgaaatctaaatcagtattgatccatcctagtgctccagatttcaaggtagctcaagttcctttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagcatgccaggaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgggttaagaagattcccaaatgactgtaaaattaaatacaagcatgttgaaagtacatttcagtatctttcagtaaaatgcctattttgttctc

SEQ ID NO: 132304 - DNA, 463 bp, Homo sapiens
  Payload ID: 5837
  Gene Symbol: FAM186A
  Gene Name: family with sequence similarity 186, member A
  ENST ID: ENST00000539751
  CDS Start-End: 1-220
gaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgggttaagaagattcccaaatgactgtaaaattaaatacaagcatgttgaaagtacatttcagtatctttcagtaaaatgcctattttgttctcttt

SEQ ID NO: 132305 - DNA, 8200 bp, Homo sapiens
  Payload ID: 5837
  Gene Symbol: FAM186A
  Gene Name: family with sequence similarity 186, member A
  ENST ID: ENST00000543111
  CDS Start-End: 139-7185
accaattagtagcagagtatgccacaacttctaggatcaggaaagacctctcctagcttcctactggatatctttattagcatttttgtagattctgtgaaaaagaagaaataaaacgaaatcacccacattttcaaaatgttcttcaaaatgaaaaatgagatagacaatgaccctgaatcagaaaaatgcatcaaggattccaccatcatgagaagagagccccaaaatatccttagtcctttgatgctccctaaccttgagatcccattctcagtaaaggatatcatctctaggattgagcgcgcacagctccatcgagccagagaggacattgatatgcagctgagtgaaataatgaacaatgtgcatcggataatgactcgctatactcttgtttttaactcgtcctctgaaaggaatgtctcccttacagaacataagaaaaaacagagaaccaattttcttgagaaaatggctacttacgctaagactattgaaataagagaaaagactcttgccaacattctggcctggttggaagaatggaatgatgttttgtctgagatgactctaatggatgttgatgaacaccaccactggatagcacaaatggagttgttaccggacacgttaaaagctattgagaacaatgtcaagatactaagcagatttagtacatctttcctcgacgaaaagaagaaacaaaagaaaaaaatattatctagaggtactctatggaaatcttggaaagaaagagttataaaacgaccttcaacagcccgtgctttaagaccagatcagatgattagtgatcaacttgcaacaaatacaaaggtttcagaaatccaaggtatgctacaggaactcataggcaccacaatgttcagtacattggaaaacaatgctattaaatatatatcatcaacaatagtaaacctttctacagctttgagtatgctaaatgatgaattaaaatgtgttaacttccaaagttccactgtgtatgcacatgagacaagtgaagcagaaaaggagctctctctgaagataatacgagatctcagtaacgaaaatgaaatgcttcagcagaaacttcaagatgcagaagaaaaatgtgaacaacttattcgatccaaaattgttatagaacaactatatgcaaaattgtccacatcatcaaccttgaaagtgttacctggaccttctccacagtcatccagggcgataatcaaagttggtgatactgaggacaatatggacaatattttagacaaggaacttgaaaatattgtagatgaagtccaaagaaaagagaccaaggactctgggataaaatgggactccactatttcatatacagcccaagctgaaagaactccagatttaactgaactacgacagcaacctgttgcttctgaagatatttccgaagacagcactaaagataacgtatcattgaagaaaggtgatttctatcaggaagatgagactgatgagtatcaatcatggaaaagaagccacaaaaaagccacatatgtatatgagacctctggaccaaatctgagtgataataaaagtggacagaaagtctcagaggccaaacctagtcaatactatgagctacaagtactgaaaaagaaaagaaaagaaatgaaatccttttctgaagataaatcaaagtcacccactgaagcaaaaagaaaacatctctctttaactgaaacaaagagccaaggtggcaaaagtggaacaagtatgatgatgttggagcaatttaggaaggtcaaacgtgaatctccatttgacaaacgtccaactgcagcagagattaaagtggaacccaccactgagtcattggacaaagagggcaaaggtgaaattagaagcctagtggagccactcagtatgatccaatttgatgatactgctgagccacagaaaggaaaaataaaaggaaagaaacaccatatctcttcaggaactatcacaagcaaagaagaaaaaactgaagagaaggaagagttgaccaaacaagtcaagtctcatcaacttgttaaatcactctcaagagtggctaaagagacttcagaatctaccagagttctagaaagtccagatggcaaaagtgaacagagtaacctcgaagaatttcaggaagccataatggctttcctaaaacagaaaattgataacataggaaaggcttttgacaaaaagactgttccgaaggaagaggagttattaaaaagagcagaagctgaaaaattaggaatcataaaggcaaaaatggaggaatatttccaaaaagtggctgaaactgtgactaaaatcttgagaaaatacaaagatacaaaaaaggaagaacaagttggagagaaacctataaaacaaaaaaaggtagtctcatttatgccaggattgcattttcagaagtcaccaattagtgcaaaatctgaaagcagtaccctcctctcatatgagagcacagatccagtaattaacaatttaatacaaatgatcttggctgaaatagaaagtgaaagagatattccaacagtctcaacagtacagaaagaccacaaggagaaggaaaaacaaaggcaggagcaatatttgcaagagggtcaagaacaaatgtctggcatgagtctcaaacagcagttgctgggagaaagaaatctcttgaaggagcactatgagaagataagtgagaattgggaagaaaaaaaggcatggctccagatgaaggagggaaagcaagaacaacagagccagaaacagtggcaggaagaagagatgtggaaggaagagcaaaaacaggcaactccaaagcaggctgagcaagaggaaaagcaaaagcaaagaggacaggaggaagaagagcttccaaagtcaagcctgcagcggctggaagaagggacccaaaaaatgaaaacacaagggttgctcttggaaaaggagaatggacagatgaggcagattcagaaggaagcgaaacatttggggccacacaggagaagggagaaagggaaggaaaagcagaagccagagagagggctagaggacctcgaaaggcagatcaaaacaaaggatcagatgcagatgaaggaaacacaacctaaagagctagaaaaaatggtcatccaaactccaatgacattatctcccaggtggaagagtgtattgaaagatgtacagcggtcatatgaaggaaaagagtttcagaggaatctgaagacattagagaaccttcctgatgaaaaggagcccatatcaatcacacctcccccctccctacaatactccctgcctggagctcttcctatttctggccagcctctcactaaatgcattcatctcacacctcagcaggcccaggaagtggggatcacactcactcctcagcaggcccaggctcaggggatcacgctcacccttcagcaggcccaggaactagggatccctctcacccctcagcaggcccaggccctggagatccttttcacccctcagcaggcgcaggccctggggatccctctcacccctcagcagacccaggttcaagggatcactctcacccctcagcaggaccaggccccggggatctctctcaccactcagcaggctcagaaactagggatccctcttacccctcagcaggcccaggccctggggatccctctcacccctcagcaggctcaggaattggggatccctctcacccctcagcaggcccaggccctgagggtctctctcacccctcagcaggctcaggaattggggatccctctcacccctcagcaggcccaggccctggggatcactctaacccttcagcaggcccagcaattggggatccctctcacccctcagcaggcgcaggctctcggaatcactctcacccctaagcaggttcaggaactggggatccctcttactcctcagcaggcccaggccctggggatcactctcacccctaagcaggctcaggaattggggatccctctcaaccctcagcaggcccagaccctggggatccctctcacccctaagcaggcacaggctctggggatccctttcacccctcagcaggcgcaggccctggggatccctctcacccctcagcaggcgcagactcaggagatcactctcacccctcagcaggcccaggccttggggatgcctctcaccactcagcaggctcaggaactggggatccctctcacccctcagcacgctcaggccttggggatgcctctcaccactcagcaggctcaggaactggggatccctctcacccctcagcaggctcaggccttggggatgcctctcaccactcagcaggctcaggaactggggatccctctcacccctcagcaggctcaggaattggggatccctttcacccctcagcaggcacaggctcaggagatcactctcacccctcagcaggcccaggccctggggatgcctctcaccgctcagcaggctcaggagctggggatcactctcacccctcagcaggctcaggaattggggatccctctcacccctcagcaggcccaggccctggggatccctctcatccctccgcaggctcaggaattggggatccctctcacccctcagcaggcccaggccctggggatccttctcatccctccgcaggctcaggaattggggatccctctcacccctcagcaggcccaggccctggggatccctctgatccctccgcaggctcaggaattggggatccctctcacccctcagcaggtccaggccctggggatccctctcatccctccgcaggctcaggaattggagatccctctcacccctcagcaggcccaggccctggggatccctctcacccctcagcaggcgcaggaactggggatccctctcacccctcagcaggcgcaggaactggggatccctctcacccctcagcaggcgcaggctcaggggatccctctcacccctcagcaggcccaggctctggggatctctctcacccctcagcaggcgcaggctcaggggatcactctcacccctcagcaggcccaggcactgggagtccccatcaccccagtaaatgcctgggtgtcagctgtcactcttacctctgagcaaacccacgctttggagtcccctatgaacttagaacaggctcaagaacagttattgaagttaggggttcctctcaccttagataaagcccataccttgggatcgcccctcacccttaagcaagtccagtggtcccatagaccatttcagaaatcgaaggcttctctccccactgggcaatccatcatatcaagattgtctccaagtcttaggctgtccctggcatcatcagctcctactgctgagaagtcctctatattcggggtctcttctactcctttgcagatatcaagggttcccctcaaccaaggcccctttgcccctgggaagcccctagaaatggggattctttctgagcctgggaagcttggggcaccacagactcttcgttcctctggacagaccctggtatacggaggtcaatccacttctgcgcagttcccggcaccacaggcccctccctcccctgggcagctcccaatatctcgggcccctcccactccagggcagccctttatagctggagttccacccacttctggacagattccaagtctctgggctcctctttctcctgggcagcccttagttcctgaagcctcttccatccctggggacctcctggaatctggacccttaaccttctctgagcagctccaggaattccagcctcctgccactgctgagcaatctccctatctgcaggctccttctacccctgggcagcatctggcaacatggacccttcctgggcgagcttcttcattatggatccctcccacctctagacatcctcccacactatggccgtccccagcccctggaaagccccagaaaagttggtccccttctgttgctaagaaaagattggcaattatttcttctctgaaatctaaatcagtattgatccatcctagtgctccagatttcaaggtagctcaagttcctttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagcatgccaggaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgttcttcaggttgaacatcttcatttctgggctactactatgaccactcaagaaagagtatcttctgctctacattactggaaacacaaaggttcaacaaccctggggtaggctgagtcatgaaagggacatcattatgggcccctaacatgatggcaaagtggcacagtctgcctttcccagtctaaacccgaagatgcctcagaaggaagaaataaatgagtataatgaaggaaactaaaaaccagcagacacccctgaagaattagaaggtggttatgattggtaatgaagggaaatcataatgttaccagtagagggttgtgactgcaagttgtccaggttcttggcattttgaacaaagaattgggcaaaatgcccagcaaagcaaataaagaatgaagcaacagaagaacgaaagcagggatttattgagaacaaaagtacactccacagtgcaggagtggcccgagcagctgctcaaggacctggatacagaatcttcttgggtccaaataccctctagaagttgcctattgatcacttcatgctcacctcatgtaaataaagcggtagcctgcaatcagtctgattggttgcagcaaaaagcaaccaatcagaggctagggtgaagttacaaacttatactcctatttttttttttttttgagacagagtttcgctcttgttgcccaggctggagtgccatggtgcgatctcggttcttgaaattctgcctcccaggttcaagcgattctcctgcctcagcttcccgagtagctgggtttacaggcatgcaccaccatgcctggctaattttgtatttttagtagagacagtgtttctccatgttggtcaggcggtttcgaactcccagcctgaggtgatccacctgccttgccgtcccaaagtgctgggattacaggcatgagccaccacgccaggtctcaaagttacacttttatgcaaacaaagactggcctgcaatcagtctgattcattgagggcagccaatttcccatctgcctc

SEQ ID NO: 132306 - DNA, 2116 bp, Homo sapiens
  Payload ID: 5837
  Gene Symbol: FAM186A
  Gene Name: family with sequence similarity 186, member A
  ENST ID: ENST00000543096
  CDS Start-End: 22-1101
ttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagcatgccaggaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgttcttcaggttgaacatcttcatttctgggctactactatgaccactcaagaaagagtatcttctgctctacattactggaaacacaaaggttcaacaaccctggggtaggctgagtcatgaaagggacatcattatgggcccctaacatgatggcaaagtggcacagtctgcctttcccagtctaaacccgaagatgcctcagaaggaagaaataaatgagtataatgaaggaaactaaaaaccagcagacacccctgaagaattagaaggtggttatgattggtaatgaagggaaatcataatgttaccagtagagggttgtgactgcaagttgtccaggttcttggcattttgaacaaagaattgggcaaaatgcccagcaaagcaaataaagaatgaagcaacagaagaacgaaagcagggatttattgagaacaaaagtacactccacagtgcaggagtggcccgagcagctgctcaaggacctggatacagaatcttcttgggtccaaataccctctagaagttgcctattgatcacttcatgctcacctcatgtaaataaagcggtagcctgcaatcagtctgattggttgcagcaaaaagcaaccaatcagaggctagggtgaagttacaaacttatactcctatttttttttttttttgagacagagtttcgctcttgttgcccaggctggagtgccatggtgcgatctcggttcttgaaattctgcctcccaggttcaagcgattctcctgcctcagcttcccgagtagctgggtttacaggcatgcaccaccatgcctggctaattttgtatttttagtagagacagtgtttctccatgttggtcaggcggtttcgaactcccagcctgaggtgatccacctgccttgccgtcccaaagtgctgggattacaggcatgagccaccacgccaggtctcaaagttacacttttatgcaaacaaagactggcctgcaatcagtctgattcattgagggcagccaatttcccatctgcctc

SEQ ID NO: 132307 - DNA, 2944 bp, Homo sapiens
  Payload ID: 5838
  Gene Symbol: FAM186B
  Gene Name: family with sequence similarity 186, member B
  Uniprot ID: Q8IYM0
  ENST ID: ENST00000257894
  CDS Start-End: 163-2844
agttggaacctggtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggtgcgaggctgatggtcaatgtggattctccccaataaatctctctccaggctttaa

SEQ ID NO: 132308 - DNA, 3088 bp, Homo sapiens
  Payload ID: 5838
  Gene Symbol: FAM186B
  Gene Name: family with sequence similarity 186, member B
  ENST ID: ENST00000533372
  CDS Start-End: 151-324
gtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggtagcccctgagatgaaggaatcactcttacattgggatctgatgcggagactgggggctgatcccaggtttgagtgagattccagctctgggtcctcagaggccctgggatattcagcaacctgggtctgcagacagattagtataaattatctctctcctaaacttggcatatacagggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccggctcttggcactgtgcttaaggggcctggtggctgaacttgctctggtgatggaggactttgaccttctgcacgtcctctagcgagctctctggcaagcatgcagagtgtctgacattcttctcctgctttggtaacaatttcatcttcttaaaggcaaagaaagcctgcacgggccaagctgtgaagccaagagggttggaagacaaatatatatgtgtgtgt

SEQ ID NO: 132309 - DNA, 1901 bp, Homo sapiens
  Payload ID: 5838
  Gene Symbol: FAM186B
  Gene Name: family with sequence similarity 186, member B
  ENST ID: ENST00000532262
  CDS Start-End: 1-1521
gggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaagcgcctcagcgaaccaaaggaaggaatgccaggaacctacaaatgaatccgcttagcttgttcaaaaaaagtcaagcgagtcactccctggaacccaaataagccagaaggatcaagacagccccagtctccactgcatccctcagccagtgattctcaaccttctgagggacggaaacccacagagaacttggtcaaaatgcaggttcccagctggtgcttttaaagaaaccctctgggggttgctgagtactcctagaactttgagaaacactgcttccctcctgcagtccccaaactctacattttaataaaatagaggttggtttattttaaaa

SEQ ID NO: 132310 - DNA, 2173 bp, Homo sapiens
  Payload ID: 5838
  Gene Symbol: FAM186B
  Gene Name: family with sequence similarity 186, member B
  ENST ID: ENST00000551047
  CDS Start-End: 142-867
agttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggagcgaaccaaaggaaggaatgccaggaacctacaaatgaatccgcttagcttgttcaaaaaaagtcaagcgagtcactccctggaacccaaataagccagaaggatcaagacagccccagtctccactgcatccctcagccagtgattctcaaccttctgagggacggaaacccacagagaacttggtcaaaatgcaggttcccagctggtgcttttaaagaaaccctctgggggttgctgagtactcctagaactttgagaaacactgcttccctcctgcagtccccaaactctacattttaataaaatagaggttggtttattttaaaattctgtctcattgctgaaacccacacctcctcaactcagttttagaaccctctgagtgttgtctgtgtcctttgggagcaaacatgccgagatagctgtgattggcacctggcacttagtaggtgtaactcttcatttaatcaaaatatggacagatatgtcactgacatgccagtgatctgcatgaaagctcagaaggtgagaacaaaaggagataccaaatacagaccagagccaggtgtcataaggtgggaggcaaaggtgagcgtgtctctgaggacaaaggtggaagacatggagacatgaggttcaaatatagacggtgtgggctaaggaggccgtctctggcaagcgtctgtcagttcagttaagacactaattcggttagttcaatcagctcacgagcacctacacaccctcctcttgacacacagctgcttgcctggtccctgctgagtctcccccaccctgtccttctccactcaccagcacccttggcctagggaacaggcatacaaataggaaattaccccatcctcagagaacccatgtccagcggttctcttcctcaggaatggcgcccatccttgcttccagcctaaggctgagactccagaaagctgaggaggatgtggggtgtgaacagctggttctgtggatgatgccaggagtaggatttgttttctgagtcgcagcttaagatatcgcgaggatgcctagtgtgggaggaaggggagttggcatcatgatgcaggacacatgcacagcacagctgtgctggccctgggctgtttccagcctctcgggtcccaggctctttcttttctggaggcctcaccccaatgatacttaacatcttaaaatgccctcacactaaatgtatcgctctaaataattagaaagcatttttataaccttgcttcagaaattaactggctatgagtaagttatttaatgtgtacttagctgtgagtgacatctcagcaatcagaatgcacagagaagaaattgaacaagttttataaatgtaatgagactattttgaatattaaatttgacagtgaatgaaa

SEQ ID NO: 132311 - DNA, 621 bp, Homo sapiens
  Payload ID: 5838
  Gene Symbol: FAM186B
  Gene Name: family with sequence similarity 186, member B
  ENST ID: ENST00000548841
  CDS Start-End: 1-353
agtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggctcttggcactgtgcttaaggggcctggtggctgaacttgctctggtgatggaggactttgaccttctgcacgtcctctagcgagctctctggcaagcatgcagagtgtctgacattcttctcctgctttggtaacaatttcatcttcttaaaggcaaagaaagcctgcacgggccaagctgtgaagccaagagggttggaagacaaatatatatgtgtgtgta

SEQ ID NO: 132312 - DNA, 3397 bp, Homo sapiens; identical to SEQ ID NO: 120662
  Payload ID: 5839
  Gene Symbol: FAM187A
  Gene Name: family with sequence similarity 187, member A
  Uniprot ID: A6NFU0
  ENST ID: ENST00000331733
  CDS Start-End: 1837-3078

SEQ ID NO: 132313 - DNA, 1748 bp, Homo sapiens
  Payload ID: 5839
  Gene Symbol: FAM187A
  Gene Name: family with sequence similarity 187, member A
  ENST ID: ENST00000412523
  CDS Start-End: 158-886
agttgctaggcaaccacagctgcgggcgtggtctgcgcggggttgccctcctgttctggtttatcaggggatccccaaagaaagcaaggggaccaaggccgggactgctggggtgaaggtccgggaggctgagtaaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttgg

SEQ ID NO: 132314 - DNA, 1184 bp, Homo sapiens
  Payload ID: 5840
  Gene Symbol: FAM187B
  Gene Name: family with sequence similarity 187, member B
  Uniprot ID: Q17R55
  ENST ID: ENST00000324675
  CDS Start-End: 50-1159
tcacaatgttcggggtggcaccagcccactgccacagccccagtccaccatgccacccatgctgtggctgctgctccactttgctgccccggcactggggttctacttttccatcagctgccccagtggtaagcagtgccaacaggccctactctcaggcaatgatattctcctgtattgcaactcctcgggggcgcactggtactatttattcacacaaggcaagaagggcaggctcaccagcctcaccaatatttccaatatggaaataatgcccgagggcagccttctcattaaagatccattgccctcccagacgggcctctaccactgctggaacaagaatggccgccaagtggtgcagtatgaaattgactttcaggatgtcaccaccctgcatataacacacaaggacctgggtcagaggcccctgcagaacgagaccctgcatttgggcagcaaacagctcatttttacctggtgggagccctggcaggactgcaaccgctgtgaggagccgggcgagtgtaaacgcctggggtaccgctacattgaggagcctctggaggaagccatgccctgctggctctatctgggagaggtgctggtgtggtctagccgcttgcggcctgagctgcaggtggaagcctgccacgtccagtgcaccaataacacacagttaagggtggattacgtcatttttgacaacttcaggctcgatgagaagacagaatttgtgtggctcgactgtcccttaggatccatgtacaggcccgtcaactggcgtgccaacgacacccccctgacgtgggagagccagctctccggccaggacttcaccacctttctggacccctccaccggcggcaggcagctgcaggttttccagccggccgtctacaagtgcttcgtgcagcaggagctcgtggcccagttcaaacccgccgccagtctggagacgctggaggctcagtggagagagaacgatgcccagtggcgggaggcaaggaaggccctgcggggcagggcggactccgtgctcaaggggctgaagctggtgctgctcgtggtcaccgtcctggccctgctgggggcgctgctcaagtgcatccacccttccccgggcaggagaagcacacaggtgctggtggtgaaataaagcgagcccccggtgcacaagcgga

SEQ ID NO: 132315 - DNA, 2381 bp, Homo sapiens
  Payload ID: 5841
  Gene Symbol: FAM188A
  Gene Name: family with sequence similarity 188, member A
  Uniprot ID: Q9H8M7
  ENST ID: ENST00000277632
  CDS Start-End: 222-1559
aagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaactgt

SEQ ID NO: 132316 - DNA, 2452 bp, Homo sapiens
  Payload ID: 5841
  Gene Symbol: FAM188A
  Gene Name: family with sequence similarity 188, member A
  ENST ID: ENST00000378036
  CDS Start-End: 1178-1630
ctctgctgttcccaaaccatccttcctactttactggctcaacattgccacattagcacatctaactcatccctcccatcataggacaaaaatactagtttctctgtccatggatacaaaagagtacctattttccacttccctcctagtgataagaataaattccacagggccagggtggtggttgaagcaggggctgctggctgattaggaaagaatttttggcctgactgccacaaacagccacttggaattccccaattataggcagtctgtaagaaaaaggaaaatgcagcaaattgtattgctaagattcgtcatttttaagttaaagtttctgtcttcatatgagagtggaattgagtggtgtgaacgtgttgggtttcataagtctattctgtttgtttagtattaaactttttttttctcagtcacacacacacaatcgtgttctcaagtttttggtatagtaatgttcacagattatgtaaccttgagagcagagtacaaatacagctttttatacattttaaagagactgttcatactgtgaaactttgaacctaccttctatcatgaagagtcaaataacaggacacttacatacttaaatggtttaaattgtaatttttcttgattatttgggagcaaagatgttctttccctttgattattcataaatctactcatttgataaactataattattttccttataaagttattatcgtcaagtttatagttttagggtttgaggtttcatgctgaaattctaagaagtggtcattttatctaggaactttagcaaaacctgagaatgactcttagggctaaatagttatctccagctgtgttaaatctatattgttgttgttttaatgtcaaagcacaatataagctcagtactgacagtcttctaacactcatttttacattcagcatttgatctctatgggtgaagtgctcgggcacaatacattatttcagttaaatacaaattggacactttatgcttcagatatttatgggcaaataagaggcagtataaatttttaatttgtttatttgttttattttgctacatttgttctaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaactgt

SEQ ID NO: 132317 - DNA, 967 bp, Homo sapiens
  Payload ID: 5841
  Gene Symbol: FAM188A
  Gene Name: family with sequence similarity 188, member A
  ENST ID: ENST00000418767
  CDS Start-End: 1-549
ttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatagtaagctaaataggaagtgttatttagccaactcaaaaagattcgattaagtttaagacatattgtacattttttgcctttttaaaaatctatatctgcatatatgaagcatagcaatctatgtaaggcaaagattaagaaatcgaactaatccaatattatagcagacttgacatacttaaattgagtttcctttcccacccagcaattactgtcctgctttttaaaaaatgctaaaagtgtctttctataaactttaaaaagtttctctgcaaacacttccccacgtcttaaaattttatgtgacattagtatcttcagtaaagtaatgacggttctgtgtagatggtgctagttgccctgcttaaataaccagcaggcctctgactttccctcttaaataaagatgatcaaagata

SEQ ID NO: 132318 - DNA, 618 bp, Homo sapiens
  Payload ID: 5841
  Gene Symbol: FAM188A
  Gene Name: family with sequence similarity 188, member A
  ENST ID: ENST00000436829
  CDS Start-End: 125-618
ctgccttggctgtcgaagagcttggctttgagcgatttcatgcattaattcaaaggccactctattctttaaataactgtatattattgaagaatttactgatgccagacagttcacctaagagatgaagaggttccctgccaaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttt

SEQ ID NO: 132319 - DNA, 2733 bp, Homo sapiens
  Payload ID: 5842
  Gene Symbol: FAM188B
  Gene Name: family with sequence similarity 188, member B
  Uniprot ID: Q4G0A6
  ENST ID: ENST00000265299
  CDS Start-End: 78-2351
atactgcgccggacagacccagttgcctggtgctgcggcccggcgtgggcctcgtgggcagagccagagccagagccatggacagcctcttcgtggaggaggtggccgcctccttggtcagggagttcctcagcagaaagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccgcacaaaagtaagcccatgcagacggtcccgggtgaaactcctgtgttgacttctgcatgggagaagatagacaagcttcactcggagccttccttggatgtgaagaggatgggagagaattccaggccaaagtctggtctgattgtgcgaggcatgatgtctgggcccatcgccagctccccacaggattcttttcacagacactatctgagacggtcctcaccgtcaagcagctccacccaaccccaagaagagagccggaaggtccctgagctctttgtctgcacccaacaggacattctggcttcgagcaacagctccccctccaggacctccctgggtcagcttagtgaactgaccgtagaaaggcagaaaaccactgccagcagccctccccatctgcccagcaaacggctgcccccatgggacagggccaggccgagggatccctccgaggacaccccagcagtggacggcagcacagacacggacaggatgcccttgaagctctacttgcctggtggtaattccaggatgacccaggagaggctggaaagagcgttcaaacggcagggcagccagcccgcacctgtcaggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaaccca

SEQ ID NO: 132320 - DNA, 4705 bp, Homo sapiens
  Payload ID: 5843
  Gene Symbol: FAM189A1
  Gene Name: family with sequence similarity 189, member A1
  Uniprot ID: O60320
  ENST ID: ENST00000261275
  CDS Start-End: 1-1620
atgcctccggccggcggcccccgagcgccgcgtcccgccgcgctgccccgcagcctgtcccgcctgcgcgagtgcccgggccgctcccgcatcgtgctggcgctcggggccacgcagatggcgctcggatgcctcatcgtggcagtcagcttcgccgcgctggcgctcaccacctcggcccgcgtccgccactcctgccccttctgggcaggcttctcggtgctgctgtcgggactcataggtgtcgtctcctggaagaggcctctctcccttgtgataacctttttcatgctgctttctgcagtgtgtgtaatgctgaatttggctggttcaattctctcttgtcagaatgctcagctagtcaactccctagaaggctgccagttgattaagtttgacagtgtggaggtgtgtgtctgctgtgagctgcagcaccagtcgtccggctgcagcaacctcggggagacgctgaagctgaacccgctgcaggagaactgcaacgctgtgaggctgaccttgaaggatctcctcttcagcgtgtgtgccctcaacgtcctgtccactatcgtgtgtgcgctggccacagccatgtgctgtatgcagatggtctcctccgatgtcctgcagatgttccttccgcagaggtcacatcctgccaaccccacctgcgtgactcctcacggcaccgttctccaccagaccctggatttcgacgagttcatccccccactcccgcctccaccctattaccccccagagtacacctgcacaccgtccactgaggcccagaggggcctccacctggactttgctccgtctccattcggcactttgtatgacgtggccatcaatagccccggcctgctctatcctgctgagctcccccctccgtacgaggcggtggtgggccagccccctgccagccaggttacaagtataggtcagcaggtggccgagtccagctccggggacccaaacaccagtgctggcttcagcactccagtaccagctgacagcacaagcctcctggtgtccgagggcactgctacgccaggttccagcccatcccccgatggccctgtgggcgccccagcaccctccgaacctgcccttccccctggccatgtgtctccagaggatcctggcatgggctcacaggtgcagccaggtcccgggcgtgtgtcccgctccaccagcgaccccaccttgtgcacatctagcatggcaggcgatgcctcttcacacaggccgtcgtgtagccaggacctggaagcgggactgtctgaggctgtgcctgggagcgcttccatgtctcgctctgccacggctgcctgtcgggcccagctttcaccagcgggggacccagatacctggaaaactgaccaacggccaacaccagagcccttcccagcgacctccaaagagcggccacgctctttagtggacagcaaggcctatgcggatgccagggttttggtggccaagtttttggaacactcacactgtgccctccccaccgaggcacagcacatggtgggtgccatgcgcttggctgtcaccaacgaggagcgcctcgaggaggaggccgtcttcggcgctgacgttctggaccaggtatgaaggagccacatttctgaccgtggacaccaacgcctggcgccacagatgttcttggcagaagccatcatgcctgacaaagaggccttcaggcccagcttggcggaggataaatgtgggggggacacccaggatgatctgggggcggtgtgggcagggaactgttaccccctctctcgaggggagccgagcagtgtctctttggggattgcatttcctgcctagcccagtaattcggaaagatgactttcacgtccacagtgaactctctggttttatctggcgtgcagcaccttgaactgagcagtgttgcacaaatgtgaatacagcaacaggcgacacttacgtcacctaaagactcaaagtatctccaaaatcagggccttccaaagcaggagtctcccatcccccatttaacttagtgttcagtggacagagggtgacatcgagtcatgaaacattttctcatgtggctcgatggctctatcattaggcgttcatcacgctctggcctatttcctgtgaaaggaaataggtagtgttagcacagatggcagcctgggcccaactttctgtccacagggctattgtgcaaacaaatgtgcagtgcgggcctctgccatagcccggccccccccagggaacaggccggtgttgcgggggttggaggaacccaccatctcctgggccttgagctcggcctccctccgtggggtgccttccccccctcctcttgggccccctttctccaggctcccatcctgtccctggagcagttgtgtgatccgtaacaacaagtgccgattcccagctcctttgtgtctgagctcacttgattgagctcagcgggtcacagttctgcaggagagaggccggtttctctgagaagtagcccctcctgataaagcaggtccctttgacccagagctgacctttccccgggcatgcggcagcagacacacctgcgcaggaggatcataaaccacttacaaacccacacgagaagggaagcagacacccaacgtgctgcttatggagaagcagacacgcccagcttggggacagcctggggaccttggactttcttagcccccatccccttgttttctggtggcatcagtggcagctgctcccaacaatggccgtggaacagcgccatccacgagaactttgtgcagtgatggaaatgcctgttcagggccactagcagccacagcccctgagctgcgttgggtgggccctgcggtgaacaaaacagcctagaggccaaggtctccccagagagcccatgagcctggcatgggggcgcagggggaccagagggtgtcttccactcctgggtgccagggcagggggctcacgctgctgttccctcggctttgtggggcttgtccttgagctcccccaattccctaatgccactgtggccagtgtgctggggagcttctgtgtggctggaagctgggaagggggtgaggttccaatccaggtgcccagagccttcctccagtcctttatccctgccctgggggctgcggtgtgggactccttcagctgtggtcggctgaaaaggcttcgattgctttagagagctgaaaacacataagccaggccttttgatgacaacctgcacttttgcaggagagacgtactagagatgaatttttgagcactttattcagactataaaacaggaaatctctaattttcctcaagtgggggcttttgaattccctcaaggcaagtccctttgcaggtgaaattaattggtggattttcagaatggccgccctggagccgagcttcagccacgcctgacgccctggcctctgaatctccactgtctctgaggtgcgctggggccacgccgcaggggtttcacctgcttgggggggtccacactagggcttgggggttcacacagcattgtccctgggctgagcccttgggtgggctagagctgcagtcctcagacatggctgcaattccagcgaggccaagaccaccagccacccagtggactcggtctctggggtgttctcctcatgcagccggggcagaggcctactggaccccctcagcctgctgctcagcatccttcccttctctgcagcagggcccggtcccaatggccaatggggctgctgccccagcagtgcctccctgtaggcccctcacctgcaccccaccttcacccagctctgggtttgcgctggtggcagctctgttttgtggatacggaaactgtacccaacttgatgccgctgggctggaaccttctgccccttcgaaatgaggcagtcagggacggggtggggtgcccccatcagccccgctgctcagggccactcatggactctaggagggtccaggttctgggcttcctgggaaggtccccagaagagagaggtgctggtagactagggaatgtgctggcaacttgacccagaagctgtggtccccttggccccggctccacggcatccgggtaccagcagcaagagcccaggccccgggctgcacgtcagctcacagcccaggagaaagctggctgcttcccctccctatgcgtctttcccccgctccaatcatgttccatctgggatctgaaatgggccaactgtggctgctttgggggtgacacgctccttctccaactcagctgggccccgggcatcccctgccctcccctgagacccaaagggggttggcacctgctgtgacaccaccgttgaccccagcctgggggccacaaggttgctgagtggggagaacatggaccccaactctatggcaagcaagatcgcagaagggggagcatcatccgcaaggacttcaggtctcccttggctggagatgaggatccacattaaatgcttgtaacacaccaggccacagaaagctcgctacacacacatgcttctccccacccatgctgactctcagaggctgctaaggcagaatttataggaaattgttttcaagccaccagagacctgtctgtacaactggaaaggctgtatttatttaatgtacctcaaggtgttttaataatgatccgtgttttaataaaaagaagtatttctgg

SEQ ID NO: 132321 - DNA, 533 bp, Homo sapiens
  Payload ID: 5843
  Gene Symbol: FAM189A1
  Gene Name: family with sequence similarity 189, member A1
  ENST ID: ENST00000560082
  CDS Start-End: 300-533
gctttaagtgttatgttgagacaccagttaaatatattccttcagatatgagaaatgcattctgtattttaaagatgagagagctcccagtagcagaaaagacgtggatttgggcagcatgcttgcagaagcatctctggagcctggagcgcagactcacacctaccctgtgacgctaaaggattcccgtctgttcttcttaagaatctgcacttaggactcagaggcaggtgctgctgtcgggactcataggtgtcgtctcctggaagaggcctctctcccttgtgataacctttttcatgctgctttctgcagtgtgtgtaatgctgaatttggctggttcaattctctcttgtcagaatgctcagctagtcaactccctagaaggctgccagttgattaagtttgacagtgtggaggtgtgtgtctgctgtgagctgcagcaccagtcgtccggctgcagcaacctcggggagacgctgaagctgaacccgctgcaggagaactgcaacgctgtgaggctgaccttgaag

SEQ ID NO: 132322 - DNA, 4705 bp, Homo sapiens
  Payload ID: 5843
  Gene Symbol: FAM189A1
  Gene Name: family with sequence similarity 189, member A1
  ENST ID: ENST00000622117
  CDS Start-End: 1-1620
atgcctccggccggcggcccccgagcgccgcgtcccgccgcgctgccccgcagcctgtcccgcctgcgcgagtgcccgggccgctcccgcatcgtgctggcgctcggggccacgcagatggcgctcggatgcctcatcgtggcagtcagcttcgccgcgctggcgctcaccacctcggcccgcgtccgccactcctgccccttctgggcaggcttctcggtgctgctgtcgggactcataggtgtcgtctcctggaagaggcctctctcccttgtgataacctttttcatgctgctttctgcggtgtgtgtaatgctgaatttggctggttcaattctctcttgtcagaatgctcagctagtcaactccctagaaggctgccagttgattaagtttgacagtgtggaggtgtgtgtctgctgtgagctgcagcaccagtcgtccggctgcagcaacctcggggagacgctgaagctgaacccgctgcaggagaactgcaacgctgtgaggctgaccttgaaggatctcctcttcagcgtgtgtgccctcaacgtcctgtccactatcgtgtgtgcgctggccacagccatgtgctgtatgcagatggtctcctccgatgtcctgcagatgttccttccgcagaggtcacatcctgccaaccccacctgcgtgactcctcacggcaccgttctccaccagaccctggatttcgacgagttcatccccccactcccgcctccaccctattaccccccagagtacacctgcacaccgtccactgaggcccagaggggcctccacctggactttgctccgtctccattcggcactttgtatgacgtggccatcaatagccccggcctgctctatcctgctgagctcccccctccgtacgaggcggtggtgggccagccccctgccagccaggttacaagtataggtcagcaggtggccgagtccagctccggggacccaaacaccagtgctggcttcagcactccagtaccagctgacagcacaagcctcctggtgtccgagggcactgctacgccaggttccagcccatcccccgatggccctgtgggcgccccagcaccctccgaacctgcccttccccctggccgcgtgtctccagaggatcctggcatgggctcacaggtgcagccaggtcccgggcatgtgtcccgctccaccagcgaccccaccttgtgcacatctagcatggcaggcgatgcctcttcacacaggccgtcgtgtagccaggacctggaagcgggactgtctgaggctgtgcctgggagcgcttccatgtctcgctctgccacggctgcctgtcgggcccagctttcaccagcgggggacccagatacctggaaaactgaccaacggccaacaccagagcccttcccagcgacctccaaagagcggccacgctctttagtggacagcaaggcctatgcggacgccagggttttggtggccaagtttttggaacactcacactgtgccctccccaccgaggcacagcacatggtgggtgccatgcgcttggctgtcaccaacgaggagcgcctcgaggaggaggccgtcttcggcgctgatgttctggaccaggtatgaaggagccacatttctgaccgtggacaccaacgcctggcgccacagatgttcttggcagaagccatcatgcctgacaaagaggccttcaggcccagcttggcggaggataaatgtgggggggacacccaggatgatctgggggcggtgtgggcagggaactgttaccccctctctcgaggggagccgagcagtgtctctttggggattgcatttcctgcctagcccagtaattcggaaagatgactttcacgtccacagtgaactctctggttttatctggcgtgcagcaccttgaactgagcagtgttgcacaaatgtgaatacagcaacaggcgacacttacgtcacctaaagactcaaagtatctccaaaatcagggccttccaaagcaggagtctcccatcccccatttaacttagtgttcagtggacagagggtgacatcgagtcatgaaacattttctcatgtggctcgatggctctatcattaggcgttcatcacgctctggcctatttcctgtgaaaggaaataggtagtgttagcacagatggcagcctgggcccaactttctgtccacagggctattgtgcaaacaaatgtgcagtgcgggcctctgccatagcccggccccccccagggaacaggccggtgttgcgggggttggaggaacccaccatctcctgggccttgagctcggcctccctccgtggggtgccttccccccctcctcttgggccccctttctccaggctcccatcctgtccctggagcagttgtgtgatccgtaacaacaagtgccgattcccagctcctttgtgtctgagctcacttgattgagctcagcgggtcacagttctgcaggagagaggccggtttctctgagaagtagcccctcctgataaagcaggtccctttgacccagagctgacctttccccgggcatgcggcagcagacacacctgcgcaggaggatcataaaccacttacaaacccacgcgagaagggaagcagacacccaacgtgctgcttatggagaagcagacacgcccagcttggggacagcctggggaccttggactttcttagcccccatccccttgttttctggtggcatcagtggcagctgctcccaacaatggccgtggaacagcgccatccacgagaactttgtgcagtgatggaaatgcctgttcagggccactagcagccacagcccctgagctgcgttgggtgggccctgcggtgaacaaaacagcctagaggccaaggtctccccagagagcccatgagcctggcatgggggcacagggggaccagagggtgtcttccactcctgggtgccagggcagggggctcacgctgctgttccctcggctttgtggggcttgtccttgagctcccccaattccctaatgccactgtggccagtgtgctggggagcttctgtgtggctggaagctgggaagggggtgaggttccaatccaggtgcccagagccttcctccagtcctttatccctgccctgggggctgcggtgtgggactccttcagctgtggtcggctgaaaaggcttcgattgctttagagagctgaaaacacataagccaggccttttgatgacaacctgcacttttgcaggagagacgtactagagatgaatttttgagcactttattcagactataaaacaggaaatctctaattttcctcaagtgggggcttttgaattccctcaaggcaagtccctttgcaggtgaaattaattggtggattttcagaatggccgccctggagccgagcttcagccacgcctgacgccctggcctctgaatctccactgtctctgaggtgcgctggggccacaccgcaggggtttcacctgcttgggggggtccacactagggcttgggggttcacacagcattgtccctgggctgagcccttgggtgggctagagctgcagtcctcagacatggctgcaattccagcgaggccaagaccaccagccacccagtggactcggtctctggggtgttctcctcatgcagccggggcagaggcctactggaccccctcagcctgctgctcagcatccttcccttctctgcagcagggcccggtcccaatggccaatggggctgctgccccagcagtgcctccctgcgggcccctcacctgcaccccaccttcacccagctctgggtttgcgctggtggcagctctgttttgtggatacggaaactgtacccaacttgatgccgctgggctggaaccttctgccccttcgaaatgaggcagtcagggacggggtggggtgcccccatcagccccgctgctcagggccactcatggactctaggagggtccaggttctgggcttcctgggaaggtccccagaagagagaggtgctggtagactagggaatgtgctggcaacttgacccagcagctgtggtccccttggccccggctccacggtatccgggtaccagcagcaagagcccaggccccgggctgcacgtcagctcacagcccaggagaaagctggctgcttcccctccctatgcgtctttcccccgctccaatcatgctccctctgggatctgaaatgggccaactgtggctgctttgggggtgacacgctccttctccaactcagctgggccccgggcatcccctgccctcccctgagacccaaagggggttggcacctgctgtgacaccaccgttgaccccagcctgggggccacaaggttgctgagtggggagaacatggaccccaactctatggcaagcaagatcgcagaagggggagcatcatccgcaaggacttcaggtctcccttggctggagatgaggatccacattaaatgtttgtaacacaccaggccacagaaagctcgctacacacagatgcttctccccacccatgctgactctcagaggctgctaaggcagaatttataggaaattgttttcaagccaccagagacctgtctgtacaactggaaaggctgtatttatttaatgtacctcaaggtgttttaataatgatccgtgttttaataaaaagaagtatttctgg

SEQ ID NO: 132323 - DNA, 2423 bp, Homo sapiens
  Payload ID: 5844
  Gene Symbol: FAM189A2
  Gene Name: family with sequence similarity 189, member A2
  Uniprot ID: Q15884
  ENST ID: ENST00000257515
  CDS Start-End: 421-1773
atttatttgaaatgactatttgttgaacacagtatagttcaaggatattttttcatatgtatttccttaagagagccctgagcctgagattttggaggcttctttcacttgtttgaactttgaaggtatattttatctattttaaaaaacacttaagaattaacaaattctataaagcatcttttttcatagttttcattcatactttcagcaacttgaagggagagtttttaacgtagtctgtgtttttgagcactctgagcatttgatttcttcctggtatcaccggtaaatcactcaatatattattattcccaaaattcgtgaagctaagagatgagccatcttgaaaaacaacctggcatttgactggaggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggc

SEQ ID NO: 132324 - DNA, 2051 bp, Homo sapiens
  Payload ID: 5844
  Gene Symbol: FAM189A2
  Gene Name: family with sequence similarity 189, member A2
  ENST ID: ENST00000303068
  CDS Start-End: 543-1400
agaaaaataaggacttgaggttattgagaagacttaagagtcagtggcatccctcagcacaattttaagaagtctaaaatgtgaaaaaaagtttgtacattgaaaacacggttctgatctttttttaaaaaaatgttctcttggaagggaatatgagtttttaaaatcaggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggcc

SEQ ID NO: 132325 - DNA, 1385 bp, Homo sapiens
  Payload ID: 5844
  Gene Symbol: FAM189A2
  Gene Name: family with sequence similarity 189, member A2
  ENST ID: ENST00000377216
  CDS Start-End: 21-734
gtggtgtcgtacatgacacaatgacgtgtttcgggccatatcctattggaactggacttcagggaataaccttgtgttgttttccctccttctgcaagatgaaaagcaggatgtgcatggctatcagcatttgtcagatgctttccatgttgagttttgtggtctgtgctttcaggtacaggcatatgttcaaaaggggttggccaatgggtacatgttgtttgtttctgcccacagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggcc

SEQ ID NO: 132326 - DNA, 2107 bp, Homo sapiens
  Payload ID: 5844
  Gene Symbol: FAM189A2
  Gene Name: family with sequence similarity 189, member A2
  Uniprot ID: Q15884
  ENST ID: ENST00000455972
  CDS Start-End: 105-1457
agtcctttcattcccgctcctaccgagatgccgggaaagcactcccgcgccgatgcgaggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggc

SEQ ID NO: 132327 - DNA, 2379 bp, Homo sapiens
  Payload ID: 5845
  Gene Symbol: FAM189B
  Gene Name: family with sequence similarity 189, member B
  Uniprot ID: P81408
  ENST ID: ENST00000350210
  CDS Start-End: 84-1802
aaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 132328 - DNA, 3082 bp, Homo sapiens
  Payload ID: 5845
  Gene Symbol: FAM189B
  Gene Name: family with sequence similarity 189, member B
  Uniprot ID: P81408
  ENST ID: ENST00000361361
  CDS Start-End: 511-2517
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttg

SEQ ID NO: 132329 - DNA, 2609 bp, Homo sapiens
  Payload ID: 5845
  Gene Symbol: FAM189B
  Gene Name: family with sequence similarity 189, member B
  Uniprot ID: P81408
  ENST ID: ENST00000368368
  CDS Start-End: 92-2044
gagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgcagctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttg

SEQ ID NO: 132330 - DNA, 1006 bp, Homo sapiens
  Payload ID: 5845
  Gene Symbol: FAM189B
  Gene Name: family with sequence similarity 189, member B
  ENST ID: ENST00000491082
  CDS Start-End: 32-1006
cgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtggg

SEQ ID NO: 132331 - DNA, 1499 bp, Homo sapiens
  Payload ID: 5845
  Gene Symbol: FAM189B
  Gene Name: family with sequence similarity 189, member B
  ENST ID: ENST00000487649
  CDS Start-End: 315-749
ggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacag

SEQ ID NO: 132332 - DNA, 2609 bp, Homo sapiens; identical to SEQ ID NO: 132329
  Payload ID: 5845
  Gene Symbol: FAM189B
  Gene Name: family with sequence similarity 189, member B
  Uniprot ID: P81408
  ENST ID: ENST00000572488
  CDS Start-End: 92-2044

SEQ ID NO: 132333 - DNA, 1006 bp, Homo sapiens; identical to SEQ ID NO: 132330
  Payload ID: 5845
  Gene Symbol: FAM189B
  Gene Name: family with sequence similarity 189, member B
  ENST ID: ENST00000574503
  CDS Start-End: 32-1006

SEQ ID NO: 132334 - DNA, 2379 bp, Homo sapiens; identical to SEQ ID NO: 132327
  Payload ID: 5845
  Gene Symbol: FAM189B
  Gene Name: family with sequence similarity 189, member B
  Uniprot ID: P81408
  ENST ID: ENST00000574749
  CDS Start-End: 84-1802

SEQ ID NO: 132335 - DNA, 3082 bp, Homo sapiens; identical to SEQ ID NO: 132328
  Payload ID: 5845
  Gene Symbol: FAM189B
  Gene Name: family with sequence similarity 189, member B
  Uniprot ID: P81408
  ENST ID: ENST00000575430
  CDS Start-End: 511-2517

SEQ ID NO: 132336 - DNA, 1499 bp, Homo sapiens; identical to SEQ ID NO: 132331
  Payload ID: 5845
  Gene Symbol: FAM189B
  Gene Name: family with sequence similarity 189, member B
  ENST ID: ENST00000573675
  CDS Start-End: 315-749

SEQ ID NO: 132337 - DNA, 1386 bp, Homo sapiens
  Payload ID: 5845
  Gene Symbol: FAM189B
  Gene Name: family with sequence similarity 189, member B
  ENST ID: ENST00000619949
  CDS Start-End: 471-1199
cctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttg

SEQ ID NO: 132338 - DNA, 1335 bp, Homo sapiens
  Payload ID: 5845
  Gene Symbol: FAM189B
  Gene Name: family with sequence similarity 189, member B
  ENST ID: ENST00000621094
  CDS Start-End: 607-1335
attcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaa

SEQ ID NO: 132339 - DNA, 1917 bp, Homo sapiens
  Payload ID: 5846
  Gene Symbol: FAM19A1
  Gene Name: family with sequence similarity 19 (chemokine (C-C motif)-like), member A1
  Uniprot ID: Q7Z5A9
  ENST ID: ENST00000496687
  CDS Start-End: 398-799
agacttgcaatgaagttagaatgaacaggaggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcatgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaa

SEQ ID NO: 132340 - DNA, 2014 bp, Homo sapiens
  Payload ID: 5846
  Gene Symbol: FAM19A1
  Gene Name: family with sequence similarity 19 (chemokine (C-C motif)-like), member A1
  Uniprot ID: Q7Z5A9
  ENST ID: ENST00000478136
  CDS Start-End: 491-892
gatactttagagcggagggatgtattgaaacagactactgctacttacagcaccgtatagcagccctgctcctacattttgctgccttactctgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacatttttttttttttaatcctgataaagaagattgttgggaagctctttgaaaaaaaattttaaattgtggcacagatggattttaaaaagtgttagatctttccaatgaacactaatagagtactctgctcttggctggatttttcagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaaccta

SEQ ID NO: 132341 - DNA, 159 bp, Homo sapiens
  Payload ID: 5846
  Gene Symbol: FAM19A1
  Gene Name: family with sequence similarity 19 (chemokine (C-C motif)-like), member A1
  ENST ID: ENST00000617084
  CDS Start-End: 1-159
ccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatggtgctattatttga

SEQ ID NO: 132342 - DNA, 4128 bp, Homo sapiens
  Payload ID: 5847
  Gene Symbol: FAM19A2
  Gene Name: family with sequence similarity 19 (chemokine (C-C motif)-like), member A2
  Uniprot ID: Q8N3H0
  ENST ID: ENST00000416284
  CDS Start-End: 1586-1981
ttttataccagttgcctcctcatcttttactgtctcgttctttttctgcaggaccgttgtttgctctcaacggcagttgctggggctaacagaactggctgttgggagagagaggcgaggcaacgccgcccggccctgccattccattttactgcttaactcaacctggagtgtcaggacctattctcctgcattctcgctgcactatacgggggagccaagtcactctgtactcactggacagccaggctgggtggaatagggttctagagtggagcaggggctctgccctttatggcgactttctaaaagattagcatcagtgtcttttgacagtatagcatctggggtgggacgcggagaggaggctttgcttgctaaacggcttctttctccgccggtgatctggatttgtttcctcggccccctccccccgctcctttctttctcccctcccgcctttagcaaagtgacacaggcgacacctgctcgcttgtgttcgatgttggaactcgcacctcctcggtggtgacggtgccagggcactgctaccagggggacatcggcgggtttcccttccttccagcccacgatgcctagaagggcagcgggtgggctgcgtggggctctgcccgcagcacttcgaggcgggattgaggggctgaagctggccaggagttgctgctaagtggattcgagtggaaggcgccaagtctccgcgagggcaccagcggggacctatctgcgagcagtgggaacaggggcacctggacggaggaacgcgggcgtctggaggggggacatcggctgagctcagagcctctcctccttcctgtcccgagcttcccagcaactccgccacgttggagacccggtacctgcgagagccagggaactcgagaagtgcgtggccgaggctgctttcctgaaggtgaatcattctgtccaattgcctttccccagagaacaagagggagggcgggagagagggaacggaggatgtgtgagtgtgtgtgtgtgtgagagggagagacgacgtgaggcgagaggaaaagtctttagtcggccttaaaagcaaacaaatcagagatggaataagagcggtaattgcagcaagaccgccttgattcttgcagtccagggagctgagcgcaccgcgcgcatccggcgaggacaggaggcgaccgcgggcgctgccaagggctgcgggactttggcttttcctcagtaaacaaatcttttgattactttgacactgtggaataaagaagcggggagaaggatcaggctcaccttcacccgcttcagggggattccagcttggatgtcagattcctgaaccgtctttgccatcggaggaggaaacacatccacacacgcgcgcgcacactcgcacgctcagggccacactcacacgccgccctccacgatcacacagcaccagacttcggttccctatgcccctggatggtgacggcggattggcatcttggaagcgatgcgagagcgataaggctggcgccggcccgcaaaagctgcaggagcatcgctaggtgttgccgccaccgggaagcggggctgcaggatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgtttttttcagggtgatgttagagacagtcaccttttgagttattggctccagatgtgactacttttcttgtttctgcaagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgtatagacaagctgacatatttccctaaggctaacaacaccctgctgaagctctttgtcaaataggtagtagttagaactggattgccattttcattatataatactttgtacctctagagcactctccctttctgtttttttttaagtgagcttttctttaattttttatgtttacttattcccttcacagaaatcagcagtgagcagtcaagttaatgggtagccttcagtttcaaaaaaattgacagggatgcatgtgagtttctgatttcttagcttgaacattattcacttagatttcttccagtattttttaaaaaactgtcctatctcattttaaaagactttcttttgcttgatcccaatgactgtttgaatgcttatatatttgttcaatctgttgatagaaaaaattgttcattttcctcagtctcaaatttataaatatttgcttacagttttcctattcaaacaatttgttaggccaatattttgtgacatttttgtagcgattttaacgtttatggttttggttctacaggaaagtcataaatatttaaaggccttaaacatgtatgtactttttttttctaagttatagaatgtataattttgtactacatttattttgtttcatttgtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatagaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaatggactctctttcataaa

SEQ ID NO: 132343 - DNA, 468 bp, Homo sapiens
  Payload ID: 5847
  Gene Symbol: FAM19A2
  Gene Name: family with sequence similarity 19 (chemokine (C-C motif)-like), member A2
  ENST ID: ENST00000549958
  CDS Start-End: 166-468
aggacttggcagccaacgttttgaaatgtaaacatccagggagatagcaactcaatctctcagtttctgtgagacgtaggagccaaacttgagcctcaaaatcaccttgtcataaagagatgagaagtttgctctcccctagagaaagccagttagcttacaccgatggtcaccccgattaccaggatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatgg

SEQ ID NO: 132344 - DNA, 2718 bp, Homo sapiens
  Payload ID: 5847
  Gene Symbol: FAM19A2
  Gene Name: family with sequence similarity 19 (chemokine (C-C motif)-like), member A2
  Uniprot ID: Q8N3H0
  ENST ID: ENST00000551619
  CDS Start-End: 191-586
aaagtaattttctgaagggaagctgcagaatatggaaaacatatattggagctacatggatcatgtcaagttcagactgtaaggagtagatgcagtagtgaagctgtccatctcaggtgaattgaaaaagtaaagaactacaaaatgccatcattccctctctgtgttgatttctggtgaagctcagaggatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgtttttttcagggtgatgttagagacagtcaccttttgagttattggctccagatgtgactacttttcttgtttctgcaagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgtatagacaagctgacatatttccctaaggctaacaacaccctgctgaagctctttgtcaaataggtagtagttagaactggattgccattttcattatataatactttgtacctctagagcactctccctttctgtttttttttaagtgagcttttctttaattttttatgtttacttattcccttcacagaaatcagcagtgagcagtcaagttaatgggtagccttcagtttcaaaaaaattgacagggatgcatgtgagtttctgatttcttagcttgaacattattcacttagatttcttccagtattttttaaaaaactgtcctatctcattttaaaagactttcttttgcttgatcccaatgactgtttgaatgcttatatatttgttcaatctgttgatagaaaaaattgttcattttcctcagtctcaaatttataaatatttgcttacagttttcctattcaaacaatttgttaggccaatattttgtgacatttttgtagcgattttaacgtttatggttttggttctacaggaaagtcataaatatttaaaggccttaaacatgtatgtactttttttttctaagttatagaatgtataattttgtactacatttattttgtttcatttgtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatagaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaatgg

SEQ ID NO: 132345 - DNA, 3252 bp, Homo sapiens
  Payload ID: 5847
  Gene Symbol: FAM19A2
  Gene Name: family with sequence similarity 19 (chemokine (C-C motif)-like), member A2
  ENST ID: ENST00000549379
  CDS Start-End: 490-885
gagggctctggctctctctcgctagagggatgccaccgccctgtcctcccgtcctcagcgttgccttcccctccctctttcccactgacgccttgaaaacccttatttgcgcattcactcacgcttgagggttaaaagattaagagtttctctaaccacggctaccctctaaaagtcacattttccccctttttccagtcactctctgaaagagaacaaagtaattttctgaagggaagctgcagaatatggaaaacatatattggagctacatggatcatgtcaagttcagactgtaaggagtagatgcagtagtgaagctgtccatctcaggtgaattgaaaaagtaaagaactacaaaatgccatcattccctctctgtgttgatttctggtgaagctcagagctgcatttcagagtcagaatgcactgggtgactgggggaagctgtgatgtatgaagcagaaagaagattgatttttcacaaggatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggcaaacgtgtaaaactcttcaagttcgaatggagaagtagaaagagaaggtttctgctgtgcctgatgacaatttttgatttctccacactcaaaaaagttttggctccatgttggagcactagttgtggcgaatcctagtgttggtcggattctaaggaagggacagaagtttcattgagaagtaaagattcaaaacaactccagaaatgagctcccgtcttggtttaaagcagcaggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgtttttttcagggtgatgttagagacagtcaccttttgagttattggctccagatgtgactacttttcttgtttctgcaagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgtatagacaagctgacatatttccctaaggctaacaacaccctgctgaagctctttgtcaaataggtagtagttagaactggattgccattttcattatataatactttgtacctctagagcactctccctttctgtttttttttaagtgagcttttctttaattttttatgtttacttattcccttcacagaaatcagcagtgagcagtcaagttaatgggtagccttcagtttcaaaaaaattgacagggatgcatgtgagtttctgatttcttagcttgaacattattcacttagatttcttccagtattttttaaaaaactgtcctatctcattttaaaagactttcttttgcttgatcccaatgactgtttgaatgcttatatatttgttcaatctgttgatagaaaaaattgttcattttcctcagtctcaaatttataaatatttgcttacagttttcctattcaaacaatttgttaggccaatattttgtgacatttttgtagcgattttaacgtttatggttttggttctacaggaaagtcataaatatttaaaggccttaaacatgtatgtactttttttttctaagttatagaatgtataattttgtactacatttattttgtttcatttgtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatagaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaa

SEQ ID NO: 132346 - DNA, 555 bp, Homo sapiens
  Payload ID: 5847
  Gene Symbol: FAM19A2
  Gene Name: family with sequence similarity 19 (chemokine (C-C motif)-like), member A2
  ENST ID: ENST00000548780
  CDS Start-End: 294-555
gcagtgatgagtcaaatattgtctcatcagcattcatcatgatgcgtctggcataaaaaagagcattcttctcctgagacacatggggagcagggaaaagtcaatcagggtgaagaagccatgcatttcttctatacatgtatgatttctcctgagatttatgttgtttatcagttcacatcacagaataagaaaatcctcactttttaactgtctactgaccagccaaaagctcctggtaatctctattctactttctgtctcaacgaatttgactattctaggtatctctcatgatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatg

SEQ ID NO: 132347 - DNA, 2499 bp, Homo sapiens
  Payload ID: 5847
  Gene Symbol: FAM19A2
  Gene Name: family with sequence similarity 19 (chemokine (C-C motif)-like), member A2
  Uniprot ID: Q8N3H0
  ENST ID: ENST00000550003
  CDS Start-End: 266-370
ctctcttgttgctcaagccccttagtgtgatctcctcatctccatcatcccagatggcaaaaatgcaggggaaggagaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgtttttttcagggtgatgttagagacagtcaccttttgagttattggctccagatgtgactacttttcttgtttctgcaagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgtatagacaagctgacatatttccctaaggctaacaacaccctgctgaagctctttgtcaaataggtagtagttagaactggattgccattttcattatataatactttgtacctctagagcactctccctttctgtttttttttaagtgagcttttctttaattttttatgtttacttattcccttcacagaaatcagcagtgagcagtcaagttaatgggtagccttcagtttcaaaaaaattgacagggatgcatgtgagtttctgatttcttagcttgaacattattcacttagatttcttccagtattttttaaaaaactgtcctatctcattttaaaagactttcttttgcttgatcccaatgactgtttgaatgcttatatatttgttcaatctgttgatagaaaaaattgttcattttcctcagtctcaaatttataaatatttgcttacagttttcctattcaaacaatttgttaggccaatattttgtgacatttttgtagcgattttaacgtttatggttttggttctacaggaaagtcataaatatttaaaggccttaaacatgtatgtactttttttttctaagttatagaatgtataattttgtactacatttattttgtttcatttgtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatagaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaa

SEQ ID NO: 132348 - DNA, 570 bp, Homo sapiens
  Payload ID: 5847
  Gene Symbol: FAM19A2
  Gene Name: family with sequence similarity 19 (chemokine (C-C motif)-like), member A2
  ENST ID: ENST00000552075
  CDS Start-End: 240-570
gccgggttttagctttcctcgccgccgagggctctggctctctctcgctagagggatgccaccgccctgtcctcccgtcctcagcgttgccttcccctccctctttcccactgacgccttgaaaacccttatttgcgcattcactcacgcttgagggtgagtcactctctgaaagagaacaaagtaattttctgaagggaagctgcagaatatggaaaacatatattggagctacatggatgatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttc

SEQ ID NO: 132349 - DNA, 580 bp, Homo sapiens
  Payload ID: 5847
  Gene Symbol: FAM19A2
  Gene Name: family with sequence similarity 19 (chemokine (C-C motif)-like), member A2
  ENST ID: ENST00000551449
  CDS Start-End: 180-329
acactcacacgccgccctccacgatcacacagcaccagacttcggttccctatgcccctggatggtgacggcggattggcatcttggaagcgatgcgagagcgataaggctggcgccggcccgcaaaagctgcaggagcatcgctaggtgttgccgccaccgggaagcggggctgcaggatgagtaagagatacttacagaaagcaacaaaaggaaaactgctaataataatatttattgtaaccttgtgggggaaagttgtatccagtgcaaaccatcataaaggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgt

SEQ ID NO: 132350 - DNA, 1056 bp, Homo sapiens
  Payload ID: 5848
  Gene Symbol: FAM19A3
  Gene Name: family with sequence similarity 19 (chemokine (C-C motif)-like), member A3
  Uniprot ID: Q7Z5A8
  ENST ID: ENST00000361886
  CDS Start-End: 60-461
gtggagtgagtctgaggacagcagatgaacagacagaaactgaaagatccccaaaaaggatgagtgagagggtcgagcggaactggagcacgggcggctggctgctggcactgtgcctggcctggctgtggacccacctgaccttggctgccttgcagcctcccactgccacagtgcttgtgcagcagggcacctgcgaggtgattgcggctcaccgctgctgcaaccggaaccgcatcgaggagcgctcccagacggtgaaatgctcctgtttttctggccaggtggccggcaccacgcgggcaaagccctcctgcgtggacgcctccatcgtcctgcagagatggtggtgtcagatggagccctgcctgccgggggaggagtgtaaggtgctcccggacctgtcgggatggagctgcagcagtggacacaaagtcaaaaccaccaaggtcacacgatagctcttgggggtcacggcctggacaagaaaggcttgactgagccgtgaactgaagaatggtatccagtcatcagccaggaaagatggggattcacttacatgcctcatgtcaaatgcagcatcagtctttccggggcatttcagttaagctgctcagcagatatggatggatctgcaatcacatacctaatgtggagctgggcttttctggagacacgaaggtcaacacacaattcctgcccttaaggaatgtccagttgaattggagagttgatgacagacaatttagataatttaggttaaagtacttgataccagactgcggcttctgggccacatgctatggcatgatgggggtttgggaatgagattcccacagttcttcagataccctgtggccacagggcatagaaacaagaggtcacattcagcacccaccacctccctctttcgcatcagttctgaatccccagcaagctgttaacatgttgcaggaaaacactctccccttatgccagaccagcagtatctcatttggatgggattggattgacttgcggaaggaaagtaaaaataaagccaaataacttcccaaa

SEQ ID NO: 132351 - DNA, 1282 bp, Homo sapiens
  Payload ID: 5848
  Gene Symbol: FAM19A3
  Gene Name: family with sequence similarity 19 (chemokine (C-C motif)-like), member A3
  Uniprot ID: Q7Z5A8
  ENST ID: ENST00000369630
  CDS Start-End: 218-727
gtccctgccctggcacctgagaacagcttcagaattgggctgaacttcagtgcccagcccacccccttgccctctcccaggttctccttcaccccctgcagagccatcggctccctctatcctttgcaaccccctatgaatctttcctacttgtccaggtggagtgagtctgaggacagcagatgaacagacagaaactgaaagatccccaaaaaggatgagtgagagggtcgagcggaactggagcacgggcggctggctgctggcactgtgcctggcctggctgtggacccacctgaccttggctgccttgcagcctcccactgccacagtgcttgtgcagcagggcacctgcgaggtgattgcggctcaccgctgctgcaaccggaaccgcatcgaggagcgctcccagacggtgaaatgctcctgtttttctggccaggtggccggcaccacgcgggcaaagccctcctgcgtggacgacctgctcttggctgcccactgtgctcgtagagaccctagagctgcactccgcctcctgctcccacagcctccatcgtcctgcagagatggtggtgtcagatggagccctgcctgccgggggaggagtgtaaggtgctcccggacctgtcgggatggagctgcagcagtggacacaaagtcaaaaccaccaaggtcacacgatagctcttgggggtcacggcctggacaagaaaggcttgactgagccgtgaactgaagaatggtatccagtcatcagccaggaaagatggggattcacttacatgcctcatgtcaaatgcagcatcagtctttccggggcatttcagttaagctgctcagcagatatggatggatctgcaatcacatacctaatgtggagctgggcttttctggagacacgaaggtcaacacacaattcctgcccttaaggaatgtccagttgaattggagagttgatgacagacaatttagataatttaggttaaagtacttgataccagactgcggcttctgggccacatgctatggcatgatgggggtttgggaatgagattcccacagttcttcagataccctgtggccacagggcatagaaacaagaggtcacattcagcacccaccacctccctctttcgcatcagttctgaatccccagcaagctgttaacatgttgcaggaaaacactctccccttatgccagaccagcagtatctcatttggatgggattggattgacttgcggaaggaaagtaaaaataaagccaaataacttcccaaa

SEQ ID NO: 132352 - DNA, 2292 bp, Homo sapiens
  Payload ID: 5849
  Gene Symbol: FAM19A4
  Gene Name: family with sequence similarity 19 (chemokine (C-C motif)-like), member A4
  Uniprot ID: Q96LR4
  ENST ID: ENST00000295569
  CDS Start-End: 494-916
aatcagcgcgttccgcggcgggcccggcccctcctggtcagcgcgctagctgggctcggctccgcactgctagctgcgcgccgccctggacggggcgcaccgactgcgcgcgcggctgcgggcaaacatcgggagtcctgcctcagctgccgcttctccagcagcagcttcaggcttctcccgcaggagcttcgggcttctcctggtagagacgtgggaacttttcttctcctggcgaggctgcagaggtgatgggccgctcccggggctcccgcggggaggcggcacggtgagcgtcctcgggctccggtgcggcgatcagtacctagttccggacgcgccggtccgacttggatgccggctctagtcgagtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgtgcacaggtgctgcaataagaaccgcatagaagagcggtcacaaacggtcaagtgctcttgcttcccgggacaggtggcgggcacaactcgggctcaaccttcttgtgttgaagcttccattgtgattcagaaatggtggtgtcacatgaatccgtgtttggaaggagaggattgtaaagtgctgccagattactcaggttggtcctgtagcagtggcaataaagtcaaaactacgaaggtaacgcggtagcgaagagagaggtgtgcttcaatcctggaggggcagcaggaggcggagctcttttgcttggattcccatcatggcccctttgcagaaaattgtctaggatttcagcaacttcatatttgtatatgtgagctgtgagaggtggcattcacttaactggcccagccctctctgcttcgtgattttatttcattgaattataaccacaagccaccacccatttgacatcctctctggattcccaaggagcatacctccaaaatccgagaagagcaaatcagagtcttcaaaatggatcaccactaagggcatgttcattcttcactttctttctgcttttacaaaagaacttggatgtatgttccaaagggtcctcattctgttcctcttttgaacttttccttttgtccttgtattaaagtggttttaaaggggtctaaaaagattttggcaaaacatatttgcagatgtagattagctggtgaagaaaattactgctagagatcaactgattaactggtaaagaacgtttattttataacccttgaagaatagaaggacatagttggattattgtgtgtgcattgtatttttacttctattttttttttgctttccattttccagttagcagagataaaatgagagcgttttaacttcaatgtaccattttactgagtgctaaggaagcatatcaattccaatattttataaccaaagctctatcagaacatatttataaaacttgttggaatttttacggcttttgtgtagtcatgtaggtaaatcatttaaaatataaaacaatctcaatttagatcaagggttatttcttagatcaaatttatgccaattatatgaaaagattttaactccgagacaggagtctttcagtgctgaatttttagactgtaaatgagttcttcttaacttagctgtttccctacttctgtgacttctgtgttagccatcttatttctttaaaatctgagtcctgattggcttaatgattttgcagcagacatgtctccacatattctcaaatgctgtcatgcggaaacgtatgaaacagatgaagaatgactgacccagattttagatgtataatgttgttaaagtacatactactgtaaaaatatgggatgaattttatatattaagaaatgccaaaaacatagtttctgcaccaagttaattatccctgtcctttcacatttatagggggaaaataaatactttaatgttgtttatagcctaacagttatttgattttattcttgcagagggaatggaaaggaatggaaagatttgttggcgtaatttttgaatatttgttatgatcatatgaataagtaaaaaaattcatcctgctgatggca

SEQ ID NO: 132353 - DNA, 602 bp, Homo sapiens
  Payload ID: 5849
  Gene Symbol: FAM19A4
  Gene Name: family with sequence similarity 19 (chemokine (C-C motif)-like), member A4
  ENST ID: ENST00000495737
  CDS Start-End: 370-602
gcgctagctgggctcggctccgcactgctagctgcgcgccgccctggacggggcgcaccgactgcgcgcgcggctgcgggcaaacatcgggagtcctgcctcagctgccgcttctccagcagcagcttcaggcttctcccgcaggagcttcgggcttctcctggtagagacgtgggaacttttcttctcctggcgaggctgcagaggtgatgggccgctcccggggctcccgcggggaggcggcacggtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgtgcacaggtgctgcaataagaaccgcatagaagagcggtcacaaacggtcaagtgctcttg

SEQ ID NO: 132354 - DNA, 1300 bp, Homo sapiens
  Payload ID: 5849
  Gene Symbol: FAM19A4
  Gene Name: family with sequence similarity 19 (chemokine (C-C motif)-like), member A4
  ENST ID: ENST00000634242
  CDS Start-End: 1128-1300
gggggcagtgaatgaatttggcatttatttccttaaacttgtaaggaaagtgaaagtgtaaagataagaaatatgactttaaaataaaaaagtctttggttgtaatcattcgtcatgcctctgatacagatttccagtcttagatataaatatttcaggatcgagacgctttcatctttctctgccttgcaagaagggaagattggaaacaatcttccttaaagtaagcagctttaatcattgtttctaaatcaactgaactgtgtagggaaaaaaagaagatgtaagaatcctataatccctggtttagttgtaatgaaaatgtccaggctgagaagggaacagatggattttgattaatttctactaagaccagcaagtatcaacctcaatattctttataaacttgtcagggtaaatgttatgtagtcataagagaatgaagaaaaaaagatttataactgggttatgaagagttaaagaggatatacttaaaaacacgatccttagcaacatgtcaaaaatgcagattcattgaatcacggcaatttttttcagagactgtttcagatttgttcctttaaaacgaagttgatatttttaagaagaggacttgtacccattgccttgggtatccagtgcagtgggccacaacatacccactacataggcttaacggtatagagtgatatatttacatagaggaaatggagaattattaatgaactatgtgatcgttgtgcctcccatcactggaatgtggaaacgtatatttactgcctgaaatgacttcacttgctgagctctgaaccacagtatttcataaatgattaacattagatggagtcagtgggaacctcacaacatttcttaaacagcattccacaagaaagaatttctcacaattgtaaggacttgcatgctggagagaaggcaagcaaggaacaaacagcactgtaaattgaataccagcagctcacgacttgaactgccattggaacccaggtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgt

SEQ ID NO: 132355 - DNA, 546 bp, Homo sapiens
  Payload ID: 5850
  Gene Symbol: FAM19A5
  Gene Name: family with sequence similarity 19 (chemokine (C-C motif)-like), member A5
  ENST ID: ENST00000336769
  CDS Start-End: 2-546
aatggcgccatcgcccaggaccggcagccggcaagatgcgaccgccctgcccagcatgtcctcaactttctgggcgttcatgatcctggccagcctgctcatcgcctactgcagtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacgtcaccctccaaacctcccaagagggcaccgccaggaatccccagctgcagacagagggctggcggctccctgggctccagagatcttcgcacatccctgctctgccagggctcccaccttgcagacaggagaaggtggctgaggcccagccagag

SEQ ID NO: 132356 - DNA, 2638 bp, Homo sapiens
  Payload ID: 5850
  Gene Symbol: FAM19A5
  Gene Name: family with sequence similarity 19 (chemokine (C-C motif)-like), member A5
  Uniprot ID: Q7Z5A7
  ENST ID: ENST00000358295
  CDS Start-End: 176-553
aaagacacaaatcgcctcccggagtggcgcctccagtcgcggcggagcgcggcgttggcggcggatggagggcgcgagcgggcggccgcggaggctgcacccggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtttttatatgttgtatatttgtagaaaatcctatttaacaattaacgtggcagtcccggccgtcctgagagtcgggccgagccccgtgtgtttctgaagactctgggggtgggacacggcggggaggtggtgccccgcggaccccggggtgccaggcacggaaggcgggactctgggagaagcgtgcggaggaccgtggcgtcggcgtcccggatgtgtcggtcgtgcccggggaggccgggttcccctcgctgcgggccaggcttggctcctgattccctctctggtccctgtattggtcaacacttgagcgtacaatatcttgaacatgcttcttccaatgggttttgtttcccatttcctgcccctttcgccactcacggaccttgaggccagttgacggcccttctccccacgcctgtgtccccgcgttctgagaagtcctctgtcttcgtgtcactaggtccagaaagtcgcgccgggcagaggcgcaggcggggccggcagggccgaggaataagcgacaattctggtttttctcccctggccgtcgttcgccagcctccttcattttcctgagttcccgctgaagtatatactacctatgagtccaattaacatgagtattatgctagttctatcctactaaaaaaaacgtaaaaaaataactatatagaagctgttccagcaaccatagactgaagatacgaaagaaaatccatttatttaagacctgttccggtatccatgaggacataatttacctttcagtcaccacaaatttataggcatttgtatcctggactaaaagaaggggctgaggttgggtttgtcatcacagagggggtgggcctggaaagggtccttcccaagctgccccggctccggcggcccgggccggcagcctctgccagccagcgtcctcacggcctccccctcgcctgtttcttttgaaagcaagtgtagacaccttcgagggcagagatcgggagatttaagatgttacagcatatttttttttcttgttttacagtattcaattttgtgttgattcagctaaattatgaaaaataaagaaaaactcctttgataa

SEQ ID NO: 132357 - DNA, 1508 bp, Homo sapiens
  Payload ID: 5850
  Gene Symbol: FAM19A5
  Gene Name: family with sequence similarity 19 (chemokine (C-C motif)-like), member A5
  Uniprot ID: Q7Z5A7
  ENST ID: ENST00000402357
  CDS Start-End: 134-532
gggcccgggcgcggcggcggcggcggcggaggatggcgcgcgcggggcccgcacgtggaggccggcgcgggggcgcgggcagggccggctgctgagacgcgctgctgccccccgcgcgggcgccgcggcttcaatggcgccatcgcccaggaccggcagccggcaagatgcgaccgccctgcccagcatgtcctcaactttctgggcgttcatgatcctggccagcctgctcatcgcctactgcagtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaa

SEQ ID NO: 132358 - DNA, 833 bp, Homo sapiens
  Payload ID: 5850
  Gene Symbol: FAM19A5
  Gene Name: family with sequence similarity 19 (chemokine (C-C motif)-like), member A5
  Uniprot ID: Q7Z5A7
  ENST ID: ENST00000406880
  CDS Start-End: 111-272
gccatgaaaatgctcagaccttttcatcccataattctgctcccagaaatttgccctaagagagtaattgaaaggaagagggaaaaaccaggaaagcacaaacacccgaaatgtaccaccaccgggaatggccagcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatgg

SEQ ID NO: 132359 - DNA, 2848 bp, Homo sapiens
  Payload ID: 5851
  Gene Symbol: FAM192A
  Gene Name: family with sequence similarity 192, member A
  Uniprot ID: Q9GZU8
  ENST ID: ENST00000309137
  CDS Start-End: 260-1024
gtcgccggaagtggggcgggactctattgtggcggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtagtgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaacaaga

SEQ ID NO: 132360 - DNA, 1017 bp, Homo sapiens
  Payload ID: 5851
  Gene Symbol: FAM192A
  Gene Name: family with sequence similarity 192, member A
  Uniprot ID: Q9GZU8
  ENST ID: ENST00000389447
  CDS Start-End: 28-792
tttgttttgtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatgaaatggagcccttccctggaactaaccagtccttgatgttgtgtgactaagtaaagatgataaacccc

SEQ ID NO: 132361 - DNA, 597 bp, Homo sapiens
  Payload ID: 5851
  Gene Symbol: FAM192A
  Gene Name: family with sequence similarity 192, member A
  ENST ID: ENST00000562324
  CDS Start-End: 102-597
accggatttccatcgggctcccggggaggaagagctccgcggattgggttacgtcgccggaagtggggcgggactctattgtggcgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggca

SEQ ID NO: 132362 - DNA, 593 bp, Homo sapiens
  Payload ID: 5851
  Gene Symbol: FAM192A
  Gene Name: family with sequence similarity 192, member A
  ENST ID: ENST00000570184
  CDS Start-End: 401-593
gtcgccggaagtggggcgggactctattgtggcgaataaacagccattggactcttcaaacaaaaacgctgtctccatcaagtactgctttcgcaggataagtgaccatttttaatcagttgaaattaacggaaagtagcagttatttttgaaagatgacatcaattatataatatagtaaagagatttaatttttagtcctttgtttcttactgcacaaattgtatggcgtttgaatagaattcccatgatactgacacttcagcaaatacttgcttgatggctaccaatctctataacttacattgcacagtacctaggaatattcatgtgagttcattcctccctgctcagattcttcagctcctcgtggttggtttattcaattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacagga

SEQ ID NO: 132363 - DNA, 618 bp, Homo sapiens
  Payload ID: 5851
  Gene Symbol: FAM192A
  Gene Name: family with sequence similarity 192, member A
  ENST ID: ENST00000565956
  CDS Start-End: 1-463
gaacggcgcaaaaggaggcaagaagaatgggagaaagttcgaaaacctgaagatccagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaa

SEQ ID NO: 132364 - DNA, 1396 bp, Homo sapiens
  Payload ID: 5851
  Gene Symbol: FAM192A
  Gene Name: family with sequence similarity 192, member A
  ENST ID: ENST00000566403
  CDS Start-End: 168-413
ggttctcagctctaccattcaccacctgtatcaccttagacaaataatctaactcctctggacctcaacttcatctgtaaacagataatatttctcatagggtcaatgatcatgtaaattagataatatccataaaaggaatataatacatgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatgtttgacccttaactggtaactcacaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtagtgaaatggagcccttccctggaactaaccagtccttgatgttgtgtgactaagtaaagatgataaacccca

SEQ ID NO: 132365 - DNA, 1029 bp, Homo sapiens
  Payload ID: 5851
  Gene Symbol: FAM192A
  Gene Name: family with sequence similarity 192, member A
  ENST ID: ENST00000565458
  CDS Start-End: 586-1029
attgtggcggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagaataaacagccattggactcttcaaacaaaaacgctgtctccatcaagtactgctttcgcaggataagtgaccatttttaatcagttgaaattaacggaaagtagcagttatttttgaaagatgacatcaattatataatatagtaaagagatttaatttttagtcctttgtttcttactgcacaaattgtatggcgtttgaatagaattcccatgatactgacacttcagcaaatacttgcttgatggctaccaatctctataacttacattgcacagtacctaggaatattcatgtgagttcattcctccctgctcagattcttcagctcctcgtggttggtttattcaattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcc

SEQ ID NO: 132366 - DNA, 621 bp, Homo sapiens
  Payload ID: 5851
  Gene Symbol: FAM192A
  Gene Name: family with sequence similarity 192, member A
  ENST ID: ENST00000566681
  CDS Start-End: 540-621
attgtggcggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagaataaacagccattggactcttcaaacaaaaacgctgtctccatcaagtactgctttcgcaggataagtgaccatttttaatcagttgaaattaacggaaagtagcagttatttttgaaagatgacatcaattatataatatagcctggatttggttctcagctctaccattcaccacctgtatcaccttagacaaataatctaactcctctggacctcaacttcatctgtaaacagataatatttctcatagggtcaatgatcatgtaaattagataatatccataaaaggaatataatacatgattggttgtttcattatggatggaggggatgatggtaaccttattatcaaaaagaggtttgtgtctgaggcagaactagatgaacggcgcaaaagga

SEQ ID NO: 132367 - DNA, 356 bp, Homo sapiens
  Payload ID: 5851
  Gene Symbol: FAM192A
  Gene Name: family with sequence similarity 192, member A
  ENST ID: ENST00000564424
  CDS Start-End: 283-356
gggagtgagaaaagagaaggattgaagttcaaatcttaaatggcacagacaaggggtttacagggaggaaggtcagaagagatataaatgaagagtcagattagtattcaggaaagtacgtggaactgaagttgggagatctgttcttccagtctcactttctccattcatggtttgtgcaccttccctgctatacagactggacttgaacactaagtcttcaatagctgagattctccatcttaatctacttggaggcaagagcagattggttgtttcattatggatggaggggatgatggtaaccttattatcaaaaagaggtttgtgtctgaggcagaactagatgaacggcg

SEQ ID NO: 132368 - DNA, 658 bp, Homo sapiens
  Payload ID: 5851
  Gene Symbol: FAM192A
  Gene Name: family with sequence similarity 192, member A
  ENST ID: ENST00000565760
  CDS Start-End: 369-658
agtggggcgggactctattgtggcggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagaatcttgccctgtcgctcaagctggggtgcagcggtgtgatcttggctcactgcaacctccgcctcccaggttcaagcgattctcctgcctcagcctcctgagtagctgggattacagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagca

SEQ ID NO: 132369 - DNA, 1055 bp, Homo sapiens
  Payload ID: 5851
  Gene Symbol: FAM192A
  Gene Name: family with sequence similarity 192, member A
  Uniprot ID: Q9GZU8
  ENST ID: ENST00000564108
  CDS Start-End: 280-1044
cggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagggtcaatgatcatgtaaattagataatatccataaaaggaatataatacatgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtcc

SEQ ID NO: 132370 - DNA, 538 bp, Homo sapiens
  Payload ID: 5851
  Gene Symbol: FAM192A
  Gene Name: family with sequence similarity 192, member A
  ENST ID: ENST00000566481
  CDS Start-End: 274-538
ggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagaataaacagccattggactcttcaaacaaaaacgctgtctccatcaaattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaact

SEQ ID NO: 132371 - DNA, 519 bp, Homo sapiens
  Payload ID: 5851
  Gene Symbol: FAM192A
  Gene Name: family with sequence similarity 192, member A
  ENST ID: ENST00000562406
  CDS Start-End: 98-519
agtgcggcctcggtcctggcctggcggcgacacctgggttccagcttccttacggaagagatgagctgcggctgctgttaggattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctat

SEQ ID NO: 132372 - DNA, 608 bp, Homo sapiens
  Payload ID: 5851
  Gene Symbol: FAM192A
  Gene Name: family with sequence similarity 192, member A
  ENST ID: ENST00000568671
  CDS Start-End: 289-608
agtgcggcctcggtcctggcctggcggcgacacctgggttccagcttccttacggaagagatgagctgcggctgctgttagggttagggccaggcctgttctcagtccgcgcacccgctccttgtccggagtagccgaagcctggggcttgcgggcccagcctgaggggagctgagggtgcccgcgggaaggcatctgggtcgcggcgaggaccctttcaggcgggcccaacactgccgggcgtttaatggggtttccccaattttctgctagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaaga

SEQ ID NO: 132373 - DNA, 676 bp, Homo sapiens
  Payload ID: 5851
  Gene Symbol: FAM192A
  Gene Name: family with sequence similarity 192, member A
  ENST ID: ENST00000566584
  CDS Start-End: 287-676
caggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagactggacttgaacactaagtcttcaatagctgagattctccatcttaatctacttggaggcaagagcagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaag

SEQ ID NO: 132374 - DNA, 1066 bp, Homo sapiens
  Payload ID: 5851
  Gene Symbol: FAM192A
  Gene Name: family with sequence similarity 192, member A
  ENST ID: ENST00000566077
  CDS Start-End: 386-919
cggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatg

SEQ ID NO: 132375 - DNA, 893 bp, Homo sapiens
  Payload ID: 5851
  Gene Symbol: FAM192A
  Gene Name: family with sequence similarity 192, member A
  ENST ID: ENST00000567044
  CDS Start-End: 412-893
aggtgagtgcggcctcggtcctggcctggcggcgacacctgggttccagcttccttacggaagagatgagctgcggctgctgttagggttagggccaggcctgttctcagtccgcgcacccgctccttgtccggagtagccgaagcctggggcttgcgggcccagcctgaggggagctgagggtgcccgcgggaaggcatctgggtcgcggcgaggaccctttcaggcgggcccaacactgccgggcgtttaatggggtttccccaattttctgctagaatcttgccctgtcgctcaagctggggtgcagcggtgtgatcttggctcactgcaacctccgcctcccaggttcaagcgattctcctgcctcagcctcctgagtagctgggattacagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagag

SEQ ID NO: 132376 - DNA, 981 bp, Homo sapiens
  Payload ID: 5851
  Gene Symbol: FAM192A
  Gene Name: family with sequence similarity 192, member A
  Uniprot ID: Q9GZU8
  ENST ID: ENST00000569266
  CDS Start-End: 72-836
tgtgagttcattcctccctgctcagattcttcagctcctcgtggttggtttattcaattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaa

SEQ ID NO: 132377 - DNA, 1086 bp, Homo sapiens
  Payload ID: 5851
  Gene Symbol: FAM192A
  Gene Name: family with sequence similarity 192, member A
  Uniprot ID: Q9GZU8
  ENST ID: ENST00000567439
  CDS Start-End: 232-996
tattgtggcggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaact

SEQ ID NO: 132378 - DNA, 4846 bp, Homo sapiens
  Payload ID: 5852
  Gene Symbol: FAM193A
  Gene Name: family with sequence similarity 193, member A
  Uniprot ID: P78312
  ENST ID: ENST00000324666
  CDS Start-End: 352-4149
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatggagtttcgctcttgttgcccagtctggggtacaatggtgcaatcttggctcactgcaaccttcgcctcccaggttcaagcgattgtgctgcctcagcctcccaagtagttggaattacagatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 132379 - DNA, 4710 bp, Homo sapiens
  Payload ID: 5852
  Gene Symbol: FAM193A
  Gene Name: family with sequence similarity 193, member A
  Uniprot ID: P78312
  ENST ID: ENST00000382839
  CDS Start-End: 352-4026
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatg

SEQ ID NO: 132380 - DNA, 4110 bp, Homo sapiens
  Payload ID: 5852
  Gene Symbol: FAM193A
  Gene Name: family with sequence similarity 193, member A
  Uniprot ID: P78312
  ENST ID: ENST00000505311
  CDS Start-End: 322-3957
ctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaagagacggggtttcgccacattgcccaggctggtctcgaactcctggcctcaagtgatctgcccacctcagcctcccaaagcgccagaattacaggttctgcttggattctgctagacagacccgacaaagactgtctatcaactggtccaattttagcttgaaaaaagccacctttgctgcccactgaatgaggactccctggagaggg

SEQ ID NO: 132381 - DNA, 4202 bp, Homo sapiens
  Payload ID: 5852
  Gene Symbol: FAM193A
  Gene Name: family with sequence similarity 193, member A
  ENST ID: ENST00000513898
  CDS Start-End: 322-2736
ctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcggggtgagtgcatgagcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattggcatggtggtgtgcacgtttgatcccagctactcaggaggctgaggcaggaggattacttgagcctggaagatggaggttccagtgagccgagatcatgcctgggtgacagaatgagacttcatataaaaaaaagaaaaaagtttttgatgaaatctctggatgtcatatggatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagaggg

SEQ ID NO: 132382 - DNA, 503 bp, Homo sapiens
  Payload ID: 5852
  Gene Symbol: FAM193A
  Gene Name: family with sequence similarity 193, member A
  ENST ID: ENST00000509050
  CDS Start-End: 374-503
gagccaagattttcttcttcactcctcgcttggtggctcccagccagaggccggcagtggtgggaggctcgctctgggtgcacagacgctgccttcagacaccgcatgctcgtgcgaggcctgcagtgagcgcagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccagg

SEQ ID NO: 132383 - DNA, 4663 bp, Homo sapiens
  Payload ID: 5852
  Gene Symbol: FAM193A
  Gene Name: family with sequence similarity 193, member A
  Uniprot ID: P78312
  ENST ID: ENST00000512465
  CDS Start-End: 352-2730
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggaggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatg

SEQ ID NO: 132384 - DNA, 3727 bp, Homo sapiens
  Payload ID: 5852
  Gene Symbol: FAM193A
  Gene Name: family with sequence similarity 193, member A
  ENST ID: ENST00000513350
  CDS Start-End: 710-3727
ggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaag

SEQ ID NO: 132385 - DNA, 4083 bp, Homo sapiens
  Payload ID: 5852
  Gene Symbol: FAM193A
  Gene Name: family with sequence similarity 193, member A
  Uniprot ID: P78312
  ENST ID: ENST00000502458
  CDS Start-End: 322-4062
ctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaacttttgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagaggg

SEQ ID NO: 132386 - DNA, 3987 bp, Homo sapiens
  Payload ID: 5852
  Gene Symbol: FAM193A
  Gene Name: family with sequence similarity 193, member A
  Uniprot ID: P78312
  ENST ID: ENST00000545951
  CDS Start-End: 352-3987
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaagagacggggtttcgccacattgcccaggctggtctcgaactcctggcctcaagtga

SEQ ID NO: 132387 - DNA, 2913 bp, Homo sapiens
  Payload ID: 5853
  Gene Symbol: FAM193B
  Gene Name: family with sequence similarity 193, member B
  Uniprot ID: Q96PV7
  ENST ID: ENST00000514747
  CDS Start-End: 50-2518
gcggcggcggcggcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacagag

SEQ ID NO: 132388 - DNA, 651 bp, Homo sapiens
  Payload ID: 5853
  Gene Symbol: FAM193B
  Gene Name: family with sequence similarity 193, member B
  ENST ID: ENST00000513282
  CDS Start-End: 1-91
ggacatggacggggtggagatggatgagactgaccgagaggtggagtactttaagagcactttgggaggccgaggcgggtggatcacctgagatcaggagttcaagaccagcctggccaagttggtgaaaccccgtctctactaaaaatagaaaaataaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 132389 - DNA, 839 bp, Homo sapiens
  Payload ID: 5853
  Gene Symbol: FAM193B
  Gene Name: family with sequence similarity 193, member B
  ENST ID: ENST00000510429
  CDS Start-End: 624-839
ctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcc

SEQ ID NO: 132390 - DNA, 717 bp, Homo sapiens
  Payload ID: 5853
  Gene Symbol: FAM193B
  Gene Name: family with sequence similarity 193, member B
  ENST ID: ENST00000507212
  CDS Start-End: 1-420
agtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagagcactttgggaggccgaggcgggtggatcacctgagatcaggagttcaagaccagcctggccaagttggtgaaaccccgtctctactaaaaatagaaaaataaggcaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctgg

SEQ ID NO: 132391 - DNA, 825 bp, Homo sapiens
  Payload ID: 5853
  Gene Symbol: FAM193B
  Gene Name: family with sequence similarity 193, member B
  ENST ID: ENST00000507587
  CDS Start-End: 1-222
gaggcgggagcgggtgcaggccctccggaggcgccggcggagcccgaccacgacggccccagggaggatgacgaacccaacctggtgcccggcccgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgca

SEQ ID NO: 132392 - DNA, 568 bp, Homo sapiens
  Payload ID: 5853
  Gene Symbol: FAM193B
  Gene Name: family with sequence similarity 193, member B
  ENST ID: ENST00000502403
  CDS Start-End: 334-568
ttgaaatctgtttcttcatcttaaaaaatgggaataagaacacctcgtttgcagagctgttacaaggactaaattttaattatgtctaaaaagtgcctaacccagtgcctggcacgtaataagtggcattactaatattgttactattattttgaaggagagcctttcccctcctgggaaaccctgtttctgtctgttggacaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggag

SEQ ID NO: 132393 - DNA, 4604 bp, Homo sapiens
  Payload ID: 5853
  Gene Symbol: FAM193B
  Gene Name: family with sequence similarity 193, member B
  ENST ID: ENST00000506955
  CDS Start-End: 84-512
gggagcggtagcggcggcggcggcggcggcggcggcggcggcggcggcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatatgaagaaacagaaactcagagcaactaaacatttgcccaaatgactccaactgtaggtgtcagacaaaagaaaagaaaaggacttttaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcggcaaaaggaaaggaaatggcagagagaaagctatgattctgatgagtatgtatacgtgtgtaatcccagagaagtgaacgcttgggagtgatgaaggcagagtggaagcaaaaaggctctcagtcccccaagtgtgacagccagccgagggacaggccgtgagcacagacggcgccaggaaggaggctcagatcagagggcatgctggctctggccagggggaggaagcagtgcagaagtctcataagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacag

SEQ ID NO: 132394 - DNA, 2800 bp, Homo sapiens
  Payload ID: 5853
  Gene Symbol: FAM193B
  Gene Name: family with sequence similarity 193, member B
  ENST ID: ENST00000510479
  CDS Start-End: 49-411
tctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccgcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcggcaaaaggaaaggaaatggcagagagaaagctatgattctgatgagtatgtatacgtgtgtaatcccagagaagtgaacgcttgggagtgatgaaggcagagtggaagcaaaaaggctctcagtcccccaagtgtgacagccagccgagggacaggccgtgagcacagacggcgccaggaaggaggctcagatcagagggcatgctggctctggccagggggaggaagcagtgcagaagtctcataagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacag

SEQ ID NO: 132395 - DNA, 426 bp, Homo sapiens
  Payload ID: 5853
  Gene Symbol: FAM193B
  Gene Name: family with sequence similarity 193, member B
  ENST ID: ENST00000506432
  CDS Start-End: 290-426
gcagacactgcatcgggcagcaggggactctgggaggctggtgcagccagaaggcatggctcttgacagccttctagtagaatctctggaattgtgcatggcagaagaggaaagaaactaacgggtattgagcacctactttgtgccaggcccaggccaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctg

SEQ ID NO: 132396 - DNA, 2237 bp, Homo sapiens
  Payload ID: 5853
  Gene Symbol: FAM193B
  Gene Name: family with sequence similarity 193, member B
  ENST ID: ENST00000510163
  CDS Start-End: 1-325
cccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgagaagtgaacgcttgggagtgatgaaggcagagtggaagcaaaaaggctctcagtcccccaagtgtgacagccagccgagggacaggccgtgagcacagacggcgccaggaaggaggctcagatcagagggcatgctggctctggccagggggaggaagcagtgcagaagtctcataagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacaca

SEQ ID NO: 132397 - DNA, 1916 bp, Homo sapiens
  Payload ID: 5853
  Gene Symbol: FAM193B
  Gene Name: family with sequence similarity 193, member B
  ENST ID: ENST00000524677
  CDS Start-End: 1-1525
tgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacac

SEQ ID NO: 132398 - DNA, 946 bp, Homo sapiens
  Payload ID: 5854
  Gene Symbol: FAM195A
  Gene Name: family with sequence similarity 195, member A
  Uniprot ID: Q9BUT9
  ENST ID: ENST00000307650
  CDS Start-End: 180-662
gcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 132399 - DNA, 702 bp, Homo sapiens
  Payload ID: 5854
  Gene Symbol: FAM195A
  Gene Name: family with sequence similarity 195, member A
  Uniprot ID: Q9BUT9
  ENST ID: ENST00000474840
  CDS Start-End: 64-291
gcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 132400 - DNA, 1050 bp, Homo sapiens
  Payload ID: 5854
  Gene Symbol: FAM195A
  Gene Name: family with sequence similarity 195, member A
  ENST ID: ENST00000491999
  CDS Start-End: 147-344
gcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtgcccctctcagctgaggaggaaccgagagcggcgctggggcacctgagcccaggaaggcaacaggccggccgggaccgcgagtgcctggcggagcaggcgcagcccaggactcccggctcccacctccggctgtagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 132401 - DNA, 341 bp, Homo sapiens
  Payload ID: 5854
  Gene Symbol: FAM195A
  Gene Name: family with sequence similarity 195, member A
  ENST ID: ENST00000629534
  CDS Start-End: 144-341
cgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtgcccctctcagctga

SEQ ID NO: 132402 - DNA, 942 bp, Homo sapiens
  Payload ID: 5855
  Gene Symbol: FAM195B
  Gene Name: family with sequence similarity 195, member B
  ENST ID: ENST00000457257
  CDS Start-End: 1-357
atgctgccacaccagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggcgtggcctcttggtggtctgtcaggcctctgcccctgcggcacacatgcacagcca

SEQ ID NO: 132403 - DNA, 1209 bp, Homo sapiens
  Payload ID: 5855
  Gene Symbol: FAM195B
  Gene Name: family with sequence similarity 195, member B
  Uniprot ID: C9JLW8
  ENST ID: ENST00000455127
  CDS Start-End: 80-373
ggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggcgtggc

SEQ ID NO: 132404 - DNA, 925 bp, Homo sapiens
  Payload ID: 5855
  Gene Symbol: FAM195B
  Gene Name: family with sequence similarity 195, member B
  Uniprot ID: C9JLW8
  ENST ID: ENST00000538396
  CDS Start-End: 103-396
acttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 132405 - DNA, 2979 bp, Homo sapiens
  Payload ID: 5855
  Gene Symbol: FAM195B
  Gene Name: family with sequence similarity 195, member B
  Uniprot ID: C9JLW8
  ENST ID: ENST00000576730
  CDS Start-End: 2157-2450
tttttagtagagacagggtttcaccatgttcgccaggctgctctcaaactcctgacctcagctgatccacccgcctctgcctcccaaagtgttgggattacaagcgtgagccaccgtgcctgggctttttttttttttttgacacagggtcttgctctgttgcctgggctggagtgcagtgccacgatcttggctccctgcagccttgacctcctgggctcaagcagtcctcccaccccagcctctgagtagctgggactacaagtgcatgctgccacaccaggtgtgttcatatgggtgtgtgccgcatgtgtgtgggcaggtgtgtacagacaggtgtgtgcgggcggttgtatgcatgtgtgtggcagatgtattcagctaaggtgtgtgcaggtaggtatgtgtgggcaggtgtgtgtgtgtgtgtgtgtgtgcacacaaggcaaagggagccccggaagggtagttgcttgggaggatgtggggcaatcagtgggatctggggcaggagtgacaaccgaacccagcagggggatcccaggccaaaggtgtggctgcataaaggccaagtggccactggaggcagaggatgcatggggagaagagccacgggagagggcaggctgggaggcaggtacccctaaagcagcagtcggtcagtggtgagagccagcagggggcgaggcagggggctggccagtctacctgttacctgagctctgcctttctctgtaacgggagcttcccagcaggcagcatgtccctgtgggaccctcaacccaaacaggcctttccctccgtgctctggtgttcgtgggctggagtccctggcaggaggactgggcagagagaccccagagtccaagaaaggagaggtgactttgtgagcaaactgggtgctgccgtgggtggggagcccctggccctttttggacctcactcctggcctgggatggggcacagagttccagggctgggagctggttttctgctctttgctggttttgcccttgagccgtgggattcttatcacgtggtgtttgagggctggaccattgacatgaggcggaatgagccagagaggactcgaagcctcagtgctcctggccctctgtgagggctgcagccgtgtgccctggagtatctgcagccttgggcctctgggtgggcaggggagttgcttgtgctcaaagccccctcctgggaatcctgggactcccctcccccagaacctggagttgccccctctggagcagggcaggctggagaccagccctgtcagcttccccaccttggggttgtgtgtcctcagctggagtggggacactgtccagcctgccagtgtgagcgtctgagcctcaaaatagactccatttttccagagccgtggattcccctgggctgggaggccataaacgggcggcagcccagggtcttggtcaccaggtcaggcccagcagcttcctccagggccaccccctctgcccaccaggggagctggagtttggttccatctccagggtactgatgtggctcatgctctagggaaccaggaagctggacctgggtaggtgccggggagctgggatcacctttaggaagctcatccccgttttacagaaaggaaatcaaggctcagcagaagccgtgtgcccagccctgcaccagggagagcagggtcagttagctgaggggctgcaggccctctgctgcagtgagaggcagctggacatcagagatgctgacggccccaccagcccacgtggggaggggctctggccacagtgctcccggtgctggggctgaggcctccacgtctgagcctgagacgtggaggatcaaggccgctgagcgggcttgatcgcttcaagttgtgtgtgtgtctggctcgtctggccagctctctgctacctcgtagggttgcctggagcccactggctgcctgtggctggaccccagcctgtgggggacaccctggtaggcagagggaccatgcactttgttcacatctgaagggaggaggcaggtgtgccctgcgcctccccctccttctgtgctggagagggtggccctgcgtcccatgcctgcgctggcttctgtttcagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 132406 - DNA, 2775 bp, Homo sapiens
  Payload ID: 5855
  Gene Symbol: FAM195B
  Gene Name: family with sequence similarity 195, member B
  Uniprot ID: C9JLW8
  ENST ID: ENST00000574190
  CDS Start-End: 1689-1982
gttgcttgggaggatgtggggcaatcagtgggatctggggcaggagtgacaaccgaacccagcagggggatcccaggccaaaggtgtggctgcataaaggccaagtggccactggaggcagaggatgcatggggagaagagccacgggagagggcaggctgggaggcaggtacccctaaagcagcagtcggtcagtggtgagagccagcagggggcgaggcagggggctggccagtctacctgttacctgagctctgcctttctctgtaacgggagcttcccagcaggcagcatgtccctgtgggaccctcaacccaaacaggcctttccctccgtgctctggtgttcgtgggctggagtccctggcaggaggactgggcagagagaccccagagtccaagaaaggagaggtgactttgtgagcaaactgggtgctgccgtgggtggggagcccctggccctttttggacctcactcctggcctgggatggggcacagagttccagggctgggagctggttttctgctctttgctggttttgcccttgagccgtgggattcttatcacgtggtgtttgagggctggaccattgacatgaggcggaatgagccagagaggactcgaagcctcagtgctcctggccctctgtgagggctgcagccgtgtgccctggagtatctgcagccttgggcctctgggtgggcaggggagttgcttgtgctcaaagccccctcctgggaatcctgggactcccctcccccagaacctggagttgccccctctggagcagggcaggctggagaccagccctgtcagcttccccaccttggggttgtgtgtcctcagctggagtggggacactgtccagcctgccagtgtgagcgtctgagcctcaaaatagactccatttttccagagccgtggattcccctgggctgggaggccataaacgggcggcagcccagggtcttggtcaccaggtcaggcccagcagcttcctccagggccaccccctctgcccaccaggggagctggagtttggttccatctccagggtactgatgtggctcatgctctagggaaccaggaagctggacctgggtaggtgccggggagctgggatcacctttaggaagctcatccccgttttacagaaaggaaatcaaggctcagcagaagccgtgtgcccagccctgcaccagggagagcagggtcagttagctgaggggctgcaggccctctgctgcagtgagaggcagctggacatcagagatgctgacggccccaccagcccacgtggggaggggctctggccacagtgctcccggtgctggggctgaggcctccacgtctgagcctgagacgtggaggatcaaggccgctgagcgggcttgatcgcttcaagttgtgtgtgtgtctggctcgtctggccagctctctgctacctcgtagggttgcctggagcccactggctgcctgtggctggaccccagcctgtgggggacaccctggtaggcagagggaccatgcactttgttcacatctgaagggaggaggcaggtgtgccctgcgcctccccctccttctgtgctggagagggtggccctgcgtcccatgcctgcgctggcttctgtttcagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtgg

SEQ ID NO: 132407 - DNA, 765 bp, Homo sapiens
  Payload ID: 5855
  Gene Symbol: FAM195B
  Gene Name: family with sequence similarity 195, member B
  ENST ID: ENST00000570507
  CDS Start-End: 41-319
gggatctggcggtggagcgctaggatcagacgcccccgcgatgaccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccacccc

SEQ ID NO: 132408 - DNA, 577 bp, Homo sapiens
  Payload ID: 5855
  Gene Symbol: FAM195B
  Gene Name: family with sequence similarity 195, member B
  ENST ID: ENST00000576431
  CDS Start-End: 54-407
gcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagagtgagtgggggctgacctgggggcagggctgggccggcaggccgggcctcatgggcaggaggggcctgtgcccaccacctaccgcgttgtcccctggcagccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtg

SEQ ID NO: 132409 - DNA, 1123 bp, Homo sapiens
  Payload ID: 5855
  Gene Symbol: FAM195B
  Gene Name: family with sequence similarity 195, member B
  ENST ID: ENST00000573478
  CDS Start-End: 114-305
gcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggc

SEQ ID NO: 132410 - DNA, 751 bp, Homo sapiens
  Payload ID: 5855
  Gene Symbol: FAM195B
  Gene Name: family with sequence similarity 195, member B
  ENST ID: ENST00000576679
  CDS Start-End: 64-300
gcaggtgggctggtctccaccggggcgggttgtgggctcccaccctgctgtgtgccctgtctcatgcgccaggctcccccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctg

SEQ ID NO: 132411 - DNA, 618 bp, Homo sapiens
  Payload ID: 5855
  Gene Symbol: FAM195B
  Gene Name: family with sequence similarity 195, member B
  ENST ID: ENST00000575061
  CDS Start-End: 141-497
ggcggcgggtcggggcgagggtcttgctctgttgcctgggctggagtgcagtgccacgatcttggctccctgcagccttgacctcctgggctcaagcagtcctcccaccccagcctctgagtagctgggactacaagtgcatgctgccacaccagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagc

SEQ ID NO: 132412 - DNA, 1038 bp, Homo sapiens
  Payload ID: 5855
  Gene Symbol: FAM195B
  Gene Name: family with sequence similarity 195, member B
  ENST ID: ENST00000572645
  CDS Start-End: 153-509
ggaagaggcggtggcggcgggtcggggcgagggtcttgctctgttgcctgggctggagtgcagtgccacgatcttggctccctgcagccttgacctcctgggctcaagcagtcctcccaccccagcctctgagtagctgggactacaagtgcatgctgccacaccagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 132413 - DNA, 3149 bp, Homo sapiens
  Payload ID: 5856
  Gene Symbol: FAM196A
  Gene Name: family with sequence similarity 196, member A
  Uniprot ID: Q6ZSG2
  ENST ID: ENST00000424811
  CDS Start-End: 139-1506
ctccttcacggttcccacccaggagcacggccaactctcccccggaatccataacggctcacgcaaatagatttctttccgttcctcctcggagggctctccacatttatctgctcgagacgtggcagctccagaaccatggtcagtaaggacaccggcaaatgcatactcacaacgtcggagagtgaagtggaacccgccgcctgcctggccctggagatgaaatacgccctggaccccaaccggcagattaaaaaacggaacaaagccctgcaggtgcggtttaaggatatctgcgaggcacagaatgagcagagggacacacagctgtcctcgggccagctgggggagaagcgggaggccaagcccgtgtcctgcagagcagcctaccgcaaatacatgacagtgcccgcacgcaggtccatccccaacgtcaccaagagcacaggcgtgcagacctcgcccgaccttaagaagtgttaccagacgttccctctggaccgcaaaaaggggaacctcaaaagcctcccagctgcagatccctttaaaagccaaaacaatgggtttctaacagatgcgaaagagaagaacgaggctggacccatggaggaggcccggccatgtggcgcggggcgggtgcacaagaccacagccttggttttccattccaaccaacacatgaacacagtggaccagcctttgggggtcaactgcacagagccctgtaaaagcccggagccgctcagctatggagaagctgcgctccaaaactccactcggcctccatccgaagagcccgattaccagctgctcgggagggccaagcaggaccgggggaggccaaactccgaggagcccgctccacctgccctcaggagggtgtttaaaacggaggttgccaccgtttacgcacctgccctcagtgccagggcccccgagcctggtttgtcagactctgcagccgccagccagtggtcactctgcccggcagatgacgagcggaggagagccacacatctcaacgggctccaggcgccctcggaaactgccctggcctgctcacccccgatgcagtgcctgtcccccgaatgtagtgagcagccgtcgcagactcacaccccgccggggctggggaaccagcctagtcccacagcggttgctgcaggtgaagaatgccaacgaatcgtgcctcatacggaagtggtcgacctcaaagcacaacttcagatgatggagaacttgatcagttcaagccaagaaaccatcaaagtgctcttgggggtcattcaggagttggaaaaaggagaggcccatcgggaaggtgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcgagggaactgtggtgcccattcaggcacctcccacttctcgccctgcgtaccaaaaaggcctttgtaccaatagataattaacagaagcaaggtattctgtgtcactccttgccagctgttctttgcagttcactgatgtgggatgtaaaatctgaaatgaaacttacgtagtcaaagatgataagtaaaaattttcccccacccccgatctgcaagtaatacattatcaacctgcgagatggcaggctgtcaccctgtacacagctataactcataattattttcaagccttgattttttttttaaataatgagaagaaaaagcaagccttatgtttgcgaaggacttcatttttatgtttcattttgcaaataagcagggggcgagtgcaattttcagcacatcaaattccggagaaagcacaattttttcaagtggtcggagaccatgaataatctctaaaatgtgactatatgtatatttgccttcatgtgctatagcgctaagccaagtgaccacatctcagtgtcacaacgacacctcaaatttagcatcctcttcatctccagacttacgacatgtttactgctcattttccaaatggccagcagccaggagtcccccaaagtcaggatatgcctttaatcactgcaagtagacagggtcagagctattggacactaagttttcttagatctcatttttaatcttttggtacccaaaggccaaataatacattctggcaagaatctgagaacatacatagagatacacgatggataatccacccaccaataaatcacaggcattctgtgccatggcagacagtgtttttgtggatcgatcctccgagacactgttagccatggtaagtgcagccagacgttatgtacaattcgttatgctttgtattaatggtggaagccctgaccatctcaaagagaaacagtgcgtttagtttagctgctaccaagggacaatgtcgcctacatttaacctattagtaagttgtactaaacaacatacttaggggaaagctgtgaatcaaatgtttttaggtattttttaaatcaacagtaacacttagagttctctcttgattacacattgcaatgtaaatcttagttcctttattttttcactcatttctttgcacctttgcaagtatctttttatagaaatcaaatcccctagtctattaatgactttgtctatcaattttttgattttcacaataggaagtagggatcttactttgcctttttttttttttttgtacaacttaaattttgaatagtttgtgagcatacaggaaaacctagtcttgaagtttctgtccagcagtttcacatctagtggagtgctgacatgcacacctcattgactagatgccaaacacacagtggctaaccttggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaa

SEQ ID NO: 132414 - DNA, 4403 bp, Homo sapiens
  Payload ID: 5856
  Gene Symbol: FAM196A
  Gene Name: family with sequence similarity 196, member A
  Uniprot ID: Q6ZSG2
  ENST ID: ENST00000522781
  CDS Start-End: 557-1996
aagtccccggagccgaggcttcctccgcgtgagcgcggcgagtctggccgcggatgccctgtccggagtgctccgtgccgccccaggcttgccagggtccgcagcgagacatgcccgagccaggcgctgcatcgacctcgacttatctgtaagcagcggaagatcctgaaggcactaactaaggtatctccaggcaaccaaggatcttacctctcacattgagaaaaaccataacttcagagacatttcctggctccaaattcaagtcctttcagagacccctctactaattattttccagtaccactctccatggaataaaaggagttgcaaacatggcctttgtagatgcagggaaacccacgttccttttagagctgatgttaacccatgagaagcgaccacccctcgacgacttctccttcacggttcccacccaggagcacggccaactctcccccggaatccataacggctcacgcaaatagatttctttccgttcctcctcggagggctctccacatttatctgctcgagacgtggcagctccagaaccatggtcagtaaggacaccggcaaatgcatactcacaacgtcggagagtgaagtggaacccgccgcctgcctggccctggagatgaaatacgccctggaccccaaccggcagattaaaaaacggaacaaagccctgcaggtgcggtttaaggatatctgcgaggcacagaatgagcagagggacacacagctgtcctcgggccagctgggggagaagcgggaggccaagcccgtgtcctgcagagcagcctaccgcaaatacatgacagtgcccgcacgcaggtccatccccaacgtcaccaagagcacaggcgtgcagacctcgcccgaccttaagaagtgttaccagacgttccctctggaccgcaaaaaggggaacctcaaaagcctcccagctgcagatccctttaaaagccaaaacaatgggtttctaacagatgcgaaagagaagaacgaggctggacccatggaggaggcccggccatgtggcgcggggcgggtgcacaagaccacagccttggttttccattccaaccaacacatgaacacagtggaccagcctttgggggtcaactgcacagagccctgtaaaagcccggagccgctcagctatggagaagctgcgctccaaaactccactcggcctccatccgaagagcccgattaccagctgctcgggagggccaagcaggaccgggggaggccaaactccgaggagcccgctccacctgccctcaggagggtgtttaaaacggaggttgccaccgtttacgcacctgccctcagtgccagggcccccgagcctggtttgtcagactctgcagccgccagccagtggtcactctgcccggcagatgacgagcggaggagagccacacatctcaacgggctccaggcgccctcggaaactgccctggcctgctcacccccgatgcagtgcctgtcccccgaatgtagtgagcagccgtcgcagactcacaccccgccggggctggggaaccagcctagtcccacagcggttgctgcaggtgaagaatgccaacgaatcgtgcctcatacggaagtggtcgacctcaaagcacaacttcagatgatggagaacttgatcagttcaagccaagaaaccatcaaagtgctcttgggggtcattcaggagttggaaaaaggagaggcccatcgggaagggctttcatatcggacggggcaagacacagctaattgtgacacatgcaggaacagtgcatgtattatctatagtgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcgagggaactgtggtgcccattcaggcacctcccacttctcgccctgcgtaccaaaaaggcctttgtaccaatagataattaacagaagcaaggtattctgtgtcactccttgccagctgttctttgcagttcactgatgtgggatgtaaaatctgaaatgaaacttacgtagtcaaagatgataagtaaaaattttcccccacccccgatctgcaagtaatacattatcaacctgcgagatggcaggctgtcaccctgtacacagctataactcataattattttcaagccttgattttttttttaaataatgagaagaaaaagcaagccttatgtttgcgaaggacttcatttttatgtttcattttgcaaataagcagggggcgagtgcaattttcagcacatcaaattccggagaaagcacaattttttcaagtggtcggagaccatgaataatctctaaaatgtgactatatgtatatttgccttcatgtgctatagcgctaagccaagtgaccacatctcagtgtcacaacgacacctcaaatttagcatcctcttcatctccagacttacgacatgtttactgctcattttccaaatggccagcagccaggagtcccccaaagtcaggatatgcctttaatcactgcaagtagacagggtcagagctattggacactaagttttcttagatctcatttttaatcttttggtacccaaaggccaaataatacattctggcaagaatctgagaacatacatagagatacacgatggataatccacccaccaataaatcacaggcattctgtgccatggcagacagtgtttttgtggatcgatcctccgagacactgttagccatggtaagtgcagccagacgttatgtacaattcgttatgctttgtattaatggtggaagccctgaccatctcaaagagaaacagtgcgtttagtttagctgctaccaagggacaatgtcgcctacatttaacctattagtaagttgtactaaacaacatacttaggggaaagctgtgaatcaaatgtttttaggtattttttaaatcaacagtaacacttagagttctctcttgattacacattgcaatgtaaatcttagttcctttattttttcactcatttctttgcacctttgcaagtatctttttatagaaatcaaatcccctagtctattaatgactttgtctatcaattttttgattttcacaataggaagtagggatcttactttgcctttttttttttttttgtacaacttaaattttgaatagtttgtgagcatacaggaaaacctagtcttgaagtttctgtccagcagtttcacatctagtggagtgctgacatgcacacctcattgactagatgccaaacacacagtggctaaccttggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaaaaaaaatgaagagtatgtcgtgtaaacattcttcgggggccaaacaacactgcagttgtatgctttaatttaaaacacacatgtgcacacacacatcctctgcggaaacactatatgaagttcgaatccctgaatatcaataaaaggaactgagaaatattttggtgcaagaacaatgaggaagttgatcctgtaacatgaaggaagtgtaactgtttcacgtagactaaatatttaaaaatgggtttcatgttttttatactgtttttaactaaagttataaaaatgtttccaacaagttctctctccttatgttttaagaatcccaactatctcagtaaattgaaataagggtattagcagttttctaattagtaacacaaatctgtctaaacaagaggacatcctagtacacaaaataatgtcactgtttcacaccagtctagaccaaaaaaaaataaaattaaaatgttcagagtcaaaaaggaacttctgaagataaattaattcatccctaaaaattaaagtgtgttcaaaatagaaaaactattgtcaaaatcatttcatagtttaattgcaacacgtcactaacagatggtgattcttctcttggaaagattcaagtaaaaacgctgatacaaaagcaaggtaaaacgcacagggttcccttatgtagatgtacacatggcattgcatatagagattaaattattatacttgtcgttaagttctttattaatttttaaataaaaaaatcaaagatg

SEQ ID NO: 132415 - DNA, 4335 bp, Homo sapiens
  Payload ID: 5856
  Gene Symbol: FAM196A
  Gene Name: family with sequence similarity 196, member A
  Uniprot ID: Q6ZSG2
  ENST ID: ENST00000614311
  CDS Start-End: 557-1924
aagtccccggagccgaggcttcctccgcgtgagcgcggcgagtctggccgcggatgccctgtccggagtgctccgtgccgccccaggcttgccagggtccgcagcgagacatgcccgagccaggcgctgcatcgacctcgacttatctgtaagcagcggaagatcctgaaggcactaactaaggtatctccaggcaaccaaggatcttacctctcacattgagaaaaaccataacttcagagacatttcctggctccaaattcaagtcctttcagagacccctctactaattattttccagtaccactctccatggaataaaaggagttgcaaacatggcctttgtagatgcagggaaacccacgttccttttagagctgatgttaacccatgagaagcgaccacccctcgacgacttctccttcacggttcccacccaggagcacggccaactctcccccggaatccataacggctcacgcaaatagatttctttccgttcctcctcggagggctctccacatttatctgctcgagacgtggcagctccagaaccatggtcagtaaggacaccggcaaatgcatactcacaacgtcggagagtgaagtggaacccgccgcctgcctggccctggagatgaaatacgccctggaccccaaccggcagattaaaaaacggaacaaagccctgcaggtgcggtttaaggatatctgcgaggcacagaatgagcagagggacacacagctgtcctcgggccagctgggggagaagcgggaggccaagcccgtgtcctgcagagcagcctaccgcaaatacatgacagtgcccgcacgcaggtccatccccaacgtcaccaagagcacaggcgtgcagacctcgcccgaccttaagaagtgttaccagacgttccctctggaccgcaaaaaggggaacctcaaaagcctcccagctgcagatccctttaaaagccaaaacaatgggtttctaacagatgcgaaagagaagaacgaggctggacccatggaggaggcccggccatgtggcgcggggcgggtgcacaagaccacagccttggttttccattccaaccaacacatgaacacagtggaccagcctttgggggtcaactgcacagagccctgtaaaagcccggagccgctcagctatggagaagctgcgctccaaaactccactcggcctccatccgaagagcccgattaccagctgctcgggagggccaagcaggaccgggggaggccaaactccgaggagcccgctccacctgccctcaggagggtgtttaaaacggaggttgccaccgtttacgcacctgccctcagtgccagggcccccgagcctggtttgtcagactctgcagccgccagccagtggtcactctgcccggcagatgacgagcggaggagagccacacatctcaacgggctccaggcgccctcggaaactgccctggcctgctcacccccgatgcagtgcctgtcccccgaatgtagtgagcagccgtcgcagactcacaccccgccggggctggggaaccagcctagtcccacagcggttgctgcaggtgaagaatgccaacgaatcgtgcctcatacggaagtggtcgacctcaaagcacaacttcagatgatggagaacttgatcagttcaagccaagaaaccatcaaagtgctcttgggggtcattcaggagttggaaaaaggagaggcccatcgggaaggtgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcgagggaactgtggtgcccattcaggcacctcccacttctcgccctgcgtaccaaaaaggcctttgtaccaatagataattaacagaagcaaggtattctgtgtcactccttgccagctgttctttgcagttcactgatgtgggatgtaaaatctgaaatgaaacttacgtagtcaaagatgataagtaaaaattttcccccacccccgatctgcaagtaatacattatcaacctgcgagatggcaggctgtcaccctgtacacagctataactcataattattttcaagccttgattttttttttaaataatgagaagaaaaagcaagccttatgtttgcgaaggacttcatttttatgtttcattttgcaaataagcagggggcgagtgcaattttcagcacatcaaattccggagaaagcacaattttttcaagtggtcggagaccatgaataatctctaaaatgtgactatatgtatatttgccttcatgtgctatagcgctaagccaagtgaccacatctcagtgtcacaacgacacctcaaatttagcatcctcttcatctccagacttacgacatgtttactgctcattttccaaatggccagcagccaggagtcccccaaagtcaggatatgcctttaatcactgcaagtagacagggtcagagctattggacactaagttttcttagatctcatttttaatcttttggtacccaaaggccaaataatacattctggcaagaatctgagaacatacatagagatacacgatggataatccacccaccaataaatcacaggcattctgtgccatggcagacagtgtttttgtggatcgatcctccgagacactgttagccatggtaagtgcagccagacgttatgtacaattcgttatgctttgtattaatggtggaagccctgaccatctcaaagagaaacagtgcgtttagtttagctgctaccaagggacaatgtcgcctacatttaacctattagtaagttgtactaaacaacatacttaggggaaagctgtgaatcaaatgtttttaggtattttttaaatcaacagtaacacttagagttctctcttgattacacattgcaatgtaaatcttagttcctttattttttcactcatttctttgcacctttgcaagtatctttttatagaaatcaaatcccctagtctattaatgactttgtctatcaattttttgattttcacaataggaagtagggatcttactttgcctttttttttttttttgtacaacttaaattttgaatagtttgtgagcatacaggaaaacctagtcttgaagtttctgtccagcagtttcacatctagtggagtgctgacatgcacacctcattgactagatgccaaacacacagtggctaaccttggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaaaaaaaatgaagagtatgtcgtgtaaacattcttcgggggccaaacaacactgcagttgtatgctttaatttaaaacacacatgtgcacacacacatcctctgcggaaacactatatgaagttcgaatccctgaatatcaataaaaggaactgagaaatattttggtgcaagaacaatgaggaagttgatcctgtaacatgaaggaagtgtaactgtttcacgtagactaaatatttaaaaatgggtttcatgttttttatactgtttttaactaaagttataaaaatgtttccaacaagttctctctccttatgttttaagaatcccaactatctcagtaaattgaaataagggtattagcagttttctaattagtaacacaaatctgtctaaacaagaggacatcctagtacacaaaataatgtcactgtttcacaccagtctagaccaaaaaaaaataaaattaaaatgttcagagtcaaaaaggaacttctgaagataaattaattcatccctaaaaattaaagtgtgttcaaaatagaaaaactattgtcaaaatcatttcatagtttaattgcaacacgtcactaacagatggtgattcttctcttggaaagattcaagtaaaaacgctgatacaaaagcaaggtaaaacgcacagggttcccttatgtagatgtacacatggcattgcatatagagattaaattattatacttgtcgttaagttctttattaatttttaaataaaaaaatcaaagatgtttt

SEQ ID NO: 132416 - DNA, 2999 bp, Homo sapiens
  Payload ID: 5857
  Gene Symbol: FAM196B
  Gene Name: family with sequence similarity 196, member B
  Uniprot ID: A6NMK8
  ENST ID: ENST00000377365
  CDS Start-End: 1383-2990
gctaatttaaccagctcccacttaaatcaagaaataaccattattctcgtttctacctccagccaggccaaatgcaagaaaggagaaaccttagcatttgtggggtgtaggagtgtgtgtatatgcatgtgtgtgtgcctgcatatgtgtgtgtgtgtgtgtctatacacacacaggagcgtgtgtttcctctgctccatctctcctctcccttccttaaagaattcagcctgtggccactagaggtcttttcttttcacatggtagctgccgagcagtttgttcggctttttatttattcctacgtgagcagacccactacacttcttgcatataaacagtgaaaattacaatatgaaggacttattattccttcttttggagtaattttgctgctggtcaaagcctggctcattgtgcaaggaagggggaccatcctctgcaggtaattccactgcttcaaggtgctcctcgcctgcttgcagatatcagaccccagctcatctcagacctcagcccctgaggccaagcaaacatacatcatcatggaggctgcagacgtagctcaccgtgcccacatgtgaacttcggccaacacaccacaacagggactctgcccactgaatcccctgtgattcctcaatcctgtcctggtcataccccactgggttttgtgaggctatttaggaagataagtttccctcactgaagaaaagagagacagcatgaaagaaaacaatggccccaaaggaggaatttgtgattgacataaatgggaatgttcccttgggagcatcatgtatcatcaaacaagcaaacctccaggtcatttatttctccacctgtttacctgctatggaaagaagatgcatttaagtttcctgcagtttcaccctggaaattaatgctctgggaaacaaaaagctgtatgttctagacgtagcaggtttcttttggaattcactcattgggagtctggcactaccccctaaatggtacttttgttgtctttttgttcaagacagccagcttcttccaagatcagaaccgcgtgccagcctcccttgataaaccgcctaccagctctcttggtagatcagatgtttaatagttagcctaactcatttgtttttccaaggagcaattatgactacaatgaattaatattttaactgcagggaaagcattacagatagttcctacgtagactctagaggctgggaatggccaacaggatttcccatactaagaggagaggaccactccatcctggccagcagttctctatgattgaaatactatcattagatactgctccaaagacctaaggggagatgtgcctaggagaagtgtatggtcctgatccttcccactgaggctcaatggcccagcaaaatatgaaagtgagacctgtgcttctaaagcgtaacagtctagaatcagtggagtttgtgaaacaacctcaccaccgcaggagcaaatcccagcaggtgagattcaaggaagatgggaccactaagaatccaactggcctagctgaggttgacgtccaaactccagaagacccggctgtgatggggaagactcaagcaaccaggcaccatcttccccccacctactcgctctccttccccaggtcccagaaggcagggggctttcgcaacattgcaatccaaacttcccccagtctcaggaagcatttcccagttttcaaaaggaagagactcacagccagtaagtccctggtggaaatgccaacagcctcccaaagtgccatccaggtcaacggtaacctctctgaacaggacattgtgtcttctgaccttgcctacttaaggttggctcagcatcttgaggatgggcctcgaagggtcaaggtgtcccatgcattcctcccaagggtccccaaggtgcaaagcaatggtcctgttagcatatgcttggaagcaggaacttggaggtccttagagaaagccacagctgccattcaggttccagatgatatttatcacagtccttcctgggaagctagagagtctgctctcagcccagacaggtcagctgaagtaagtaactccatacaccctttggatgacacacgtccaggtgatgggagaagggtgactccactagattcagaaaaatccacctcctgcttaaatgccaccagcgttgccagccacacaccaggcacagaggaacttaaacctgaattgcttttgcccaaagacaactcagatgacaaagaccttggctcactgtcatctcagtcaaaggaaacgtgtgttccttcatctccacggactcacagttccccctcacaaggctcccacagccagccagcccacccaggaagagcctcagactgtccttcatcaagtaacaatcaccagaatctggtgtcactcaaaactaacagtgcatcgaaatctgcccctgggtgtcaggagcagacggcaaacaaccccaccgagtcagacacactggagtttccaaattgtccaggaagtaatcatctcccatcctctctttcaaggagtgagaccaaacttcagagcaacagggagattagtgacattaatcaaattcacctggcacggggtgaactctgcgacctccaaggccgactgcaatctgtggaggaatctctgcactcgaaccaagagaaaattaaagtccttttgaatgtaattcaagacttggagaaagctcgagctctcactgaagggcgcaacttttatcgaactggccaagatctcaacaattgcagtacctgccagaacacggcgtgcatcatatacagtgtagagtatgattttcggcagcaggaaggcaggttccatgaagttttgcagagtctggaggaagcagagccagttgaggaggcatcgcccccaccaaagtccccagcagaacccccagccccggaaaagcaggacttaaggcggaaaaccaagaaggtgaaaaagaaatgcttctggtggatctgagctggttgg

SEQ ID NO: 132417 - DNA, 2628 bp, Homo sapiens
  Payload ID: 5858
  Gene Symbol: FAM198A
  Gene Name: family with sequence similarity 198, member A
  Uniprot ID: Q9UFP1
  ENST ID: ENST00000273146
  CDS Start-End: 377-2104
gctttcaggggaatggggaagctgggccgggacgcgcggcagggactttgcaaactctgcaaaagtcccgagtagaccgcagaggctcgcggccgcgggtaggctccctcagatccccgtagatctcagtagatccggcgtgtattccccacccgcggagtatcccggtgtgcagcgatctcccgagagttggcgcagggccacttggctgcagagaacgtgtgcaccttcagtccgggaaacccgccccagccgagtagccgcgcatcctgggaagcctggcgagccacggcgccgggggcggccaaggggaggcgggatgagtctgcgagccggctgagcgcgccgaggagccggccggggcaccgccggggacatggcgtcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcagggggtaactggcgcccctgcaacccatatccggcaggctttgagctccagccggaggcagcgggcaagaaacatgggcttctggagaagccgtgctttgcccaggaactccatcttggtctgtgctgaggagcaaggccatagagcaagagtggacagaagcagggagtccccaggaggggacctcaggcatccagggagggtgaggagggacattactttgtcaggacatccaagactcagtactcagcatgttgtgctcctgagggaggatgaggttggagatccaggaaccaaagacctgggccacccccagcatggcagtcccatccaggagacacagagtgaggtggtcaccctggtcagtccactcccagggagtgacatggcagctttaccggcttggagagctacttctgggctgacactctggccccatacagcagaaggcagggatctgctgggagctgagaacagagccttgactggtgggcaacaagcagaggatcccaccttggcctcaggagctcatcagtggcctggctctgttgagaagctgcaagggtcagtatggtgtgatgctgagacgctgttgagcagctcgaggactggtgggcaggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcacccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcaggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctacagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggagttctttccaaggatacccttatcaagtgatgctgttcctctaggcctcagccagtttctgtttaacagtctctgctttgccttctgcctggtagacctacactcagccagaggtgggagtgagacacttgtcatcctagaaaatggcaagaagaaaggaatacaaagaaacatttcattgcaaaacataatgtggagctctcacattaggatgaggctcattctactttgtgacttaaccagccgctttgaaataaaacagatctaatcctgtctcaccaccgagagactgacatgcaagtggacaatgcccaaactacatataataataaaactctatccaccacctctgtagcaaccagctcagagaaccaaccac

SEQ ID NO: 132418 - DNA, 3121 bp, Homo sapiens
  Payload ID: 5858
  Gene Symbol: FAM198A
  Gene Name: family with sequence similarity 198, member A
  Uniprot ID: Q9UFP1
  ENST ID: ENST00000430121
  CDS Start-End: 96-1823
gcgagccacggcgccgggggcggccaaggggaggcgggatgagtctgcgagccggctgagcgcgccgaggagccggccggggcaccgccggggacatggcgtcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcagggggtaactggcgcccctgcaacccatatccggcaggctttgagctccagccggaggcagcgggcaagaaacatgggcttctggagaagccgtgctttgcccaggaactccatcttggtctgtgctgaggagcaaggccatagagcaagagtggacagaagcagggagtccccaggaggggacctcaggcatccagggagggtgaggagggacattactttgtcaggacatccaagactcagtactcagcatgttgtgctcctgagggaggatgaggttggagatccaggaaccaaagacctgggccacccccagcatggcagtcccatccaggagacacagagtgaggtggtcaccctggtcagtccactcccagggagtgacatggcagctttaccggcttggagagctacttctgggctgacactctggccccatacagcagaaggcagggatctgctgggagctgagaacagagccttgactggtgggcaacaagcagaggatcccaccttggcctcaggagctcatcagtggcctggctctgttgagaagctgcaagggtcagtatggtgtgatgctgagacgctgttgagcagctcgaggactggtgggcaggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcacccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcaggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctacagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggaggtagtatggggttttcaatctcaaagcgtccctttctgccttctcggctctggctatttattcccttgcaccaacaaatacattcgaaaatgttctgtgagctgctcaagaaactgtaaaaatgtgtgatgcacgtgcatatgcagagtgggagaactttgtgtgtgtgtagaggtgtgtaggtgtgggtggcatgtgtgcccgcctgcatgcaatacctgagaccaacctaataaaggtacaatcttcatagaactgcacttgcagcctggagttgctctggctgaaagtagactcaggcttaagaaatgaaacataatgcgtttgtctttatagactttaaattttcaattattactcagttatgtttttggtttaaaaaattataaaagtctaaaagtaatacatgctcagtaaaaacaagtccataaaaaatagaagcatatgacaaaaagcataagtcccacaaactccctagcggtgtgtatgtgtgtgtgtgttattcatggtcacactacatgcaaattaaaaaatgaaagtgtggtcatgctttgtcaactcactatatttttactttattaactatattctgtatcagccatctgaattgacccaatctttattggtgactgcatgaaattccaaggcagggatgtgtcatattttctttagctggtcccataatcatgaacatttaagtagctccaatttttcatcaattacagacattgccgccatgaacatgattgcatggcgtgcaagtatttctgcgaggtagatttccgtacgggatttctggggcaaagggtatgggcattcagtattctgagagaaactgccaaattgctctctgaaatggtggtgtcaatttacatttctcccaagagggtaggagactgattatttttctacaccttcaccaacacttggcattctcagacttttgggttttttttggcctatttaggaggaaaaccgattttaaaagctgcatttccttaatcatgaatgaagtcatctttccacttatttgccagacatttgtattttcttttctgcattgtctttttgttttaagatgtttgccctttgcttgttaatttgttggaaatctttgactctaataagtgtgatcaatcttttctctgctga

SEQ ID NO: 132419 - DNA, 783 bp, Homo sapiens
  Payload ID: 5858
  Gene Symbol: FAM198A
  Gene Name: family with sequence similarity 198, member A
  ENST ID: ENST00000488863
  CDS Start-End: 363-783
ggggaagctgggccgggacgcgcggcagggactttgcaaactctgcaaaagtcccgagtagaccgcagaggctcgcggccgcgggtaggctccctcagatccccgtagatctcagtagatccggcgtgtattccccacccgcggagtatcccggtgtgcagcgatctcccgagagttggcgcagggccacttggctgcagagaacgtgtgcaccttcagtccgggaaacccgccccagccgagtagccgcgcatcctgggaagcctggcgagccacggcgccgggggcggccaaggggaggcgggatgagtctgcgagccggctgagcgcgccgaggagccggccggggcaccgccggggacatggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctacagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactct

SEQ ID NO: 132420 - DNA, 4985 bp, Homo sapiens
  Payload ID: 5859
  Gene Symbol: FAM198B
  Gene Name: family with sequence similarity 198, member B
  Uniprot ID: Q6UWH4
  ENST ID: ENST00000296530
  CDS Start-End: 623-2182
ctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttttgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaa

SEQ ID NO: 132421 - DNA, 4544 bp, Homo sapiens
  Payload ID: 5859
  Gene Symbol: FAM198B
  Gene Name: family with sequence similarity 198, member B
  Uniprot ID: Q6UWH4
  ENST ID: ENST00000393807
  CDS Start-End: 408-1991
gtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagcagcagcagcagcgtgtctttccatgcgcttggcattctttattttcccagcctgggaggatatgagagttccagggaaatgctgtattggacatgcaagactcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaa

SEQ ID NO: 132422 - DNA, 548 bp, Homo sapiens
  Payload ID: 5859
  Gene Symbol: FAM198B
  Gene Name: family with sequence similarity 198, member B
  ENST ID: ENST00000592586
  CDS Start-End: 225-548
tttaatatttgagagagtgagaagccagcaaagcctatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgttt

SEQ ID NO: 132423 - DNA, 4900 bp, Homo sapiens
  Payload ID: 5859
  Gene Symbol: FAM198B
  Gene Name: family with sequence similarity 198, member B
  Uniprot ID: Q6UWH4
  ENST ID: ENST00000585682
  CDS Start-End: 408-1967
gtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttttgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagaagtagatttatttacacactgtcttatgaaattcttatgtttatgtcagcacagaacaagcacacatttagagcattcatctgaaaattatatggaaattgaacatgggtcaaataaagatg

SEQ ID NO: 132424 - DNA, 587 bp, Homo sapiens
  Payload ID: 5859
  Gene Symbol: FAM198B
  Gene Name: family with sequence similarity 198, member B
  ENST ID: ENST00000587787
  CDS Start-End: 561-587
attgtaaaatatagtatttttaggattatacaccatatgctaatcttttacccactcttcagtatcacaactttctttctctgtggggaggaaaaatccctgtcccctttctgtcttcttgccttttgattctatttgccatagtctaattgacaccccaaggtcatcagcccctgcctttgtgctaggacacgcaaaccacccaggccaatccctaacctgttttttcaaaaaacctccaatcagagagaatccacgacttccttttgtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatgaccacttatatcccgaagcggacgcggcagctgaagtcaggaaaccatgcatcacattagcaggagccaactgcagactttaaactccgttcaacatgtggatgcggcagagaaatgacctgtccagacaagccggggcag

SEQ ID NO: 132425 - DNA, 701 bp, Homo sapiens
  Payload ID: 5859
  Gene Symbol: FAM198B
  Gene Name: family with sequence similarity 198, member B
  ENST ID: ENST00000590648
  CDS Start-End: 139-701
aattcacatgaacacccacatatcttttaaaacccgctttctcaccactgtgacagaattttatctcttcacttgttgagatttctctagagagtccagtactgcatcattttgacaaacctgaatgtggagagatgaatgcttctcatctctgaaacacttcaggatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaag

SEQ ID NO: 132426 - DNA, 3425 bp, Homo sapiens
  Payload ID: 5859
  Gene Symbol: FAM198B
  Gene Name: family with sequence similarity 198, member B
  Uniprot ID: Q6UWH4
  ENST ID: ENST00000592057
  CDS Start-End: 404-1399
actgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaaggtaacagattcacatgcttcgttatttgcagctgttggggattctggttcattttcttttttccctcactctctttttctaaatgatttttctccacccacggttcacatttggacagcagcagcagcagcgtgtctttccatgcgcttggcattctttattttcccagcctgggaggatatgagagttccagggaaatgctgtattggacatgcaagagtaagcccatactgtataatctttgctctccatttccctcgcttcacttcccagtggcttattaaatctaattaaagccaacggcaatttgcatgatgaggagaggaagctaggctggaggcaaagaacttgctgacagtcaggcatactattaaataggttactatgggaggaagtagaagtttttaaaagtaagggggaagcgggttatcgttcttgagcagatggaatcttcttaagccgcgcagagccagaccatgttaggtttaaccccccctttttttttcaatggatttaacctctttatttaacaaataaaaagaatgagcaaaaattggtgatttgttcagtatgtatactaactagctgtgtggttttatcaagcccctgactatgatctattgagtctgtctttcaagattctcccgtcttgggtgacaaacattttggcaggttctaacacatgtagccagttactgcagttgccagcaaaaggactggtctgcggtcatgcccatgccatataaaggatattctctgaatattaaagctattccagggctcgaatacaaagtacagtgagtcagtggcttatgtttgaatgcagaatgatgccagaagttacaactttgaatccagattggcccaagaggctaaaatgtaccccaaagagattataagctgaaaggatacttaactttctccatgttaccatgaaatttagcatttcagtgaggttcccagggagcctagaatggaatggattaaaatccctgggagtggctgagacccaactgcatttccaatggctttagcattataatttcattttaaaatggatacccctggaagtaccagtgatttacttagaaaaattggacattccctactgatggtggttcttgtctaagtgctccagattcacaggtatgctttgatgtctcaagtttataaagcagtccaccacagttatgccaatgtaagaaaccttctcaaacatttaatctaatgttgataaaaatgaatttttattgggtgcccacaatttgctaaggattatacaaattgattcatatgtgttggctcctagaattttcataacaatgctatgaagtggggactattattatttccatttagtagatgagaaaattgaggcttattgagacaaagtaattggcctcaactcccacagctagtaggtggctaagctgggttttgactatagacccagcaaacttcagaacataacttcttagccactggacttaggtgaatatgtaacttattatccaaactggaaccgtgtggcgtgaaaggagatgctggtgggcattgggacaacaggcccacactgactgttctgagcagagtagagcacaggatcccccttgttatgctgaaatcccattcattttcatgtcataaaggccccagagaggagaagatgaactcctgtgtatatcctgaggcagagttctctgatatgtcctttgagcttcccttagacgctcttagactactgtattgggagaatgcagtagtggctaagagcctgggccgtggagttggactgactaggtttgaacttaccaatcatacgacttggaaatgttgccatgtctctttatgcctcagtttcctcagctgtaaaatgacaatactgcctaccatatgagattgttgttagttaatacagggaaaacacttagaaccagtatttgccacaagataaaccttcaataaatattggttattattattattattgtaccaagcacatgaggtaccaagttcattgaattcctcacataatctccaagtctcatgtgttacttcgttacgtgataggactatgactaaaactgctcaattaaacttttgtaatcccaa

SEQ ID NO: 132427 - DNA, 574 bp, Homo sapiens
  Payload ID: 5859
  Gene Symbol: FAM198B
  Gene Name: family with sequence similarity 198, member B
  ENST ID: ENST00000593260
  CDS Start-End: 1-574
ttttctccacccacggttcacatttggacagcagcagcagcagcgtgtctttccatgcgcttggcattctttattttcccagcctgggaggatatgagagttccagggaaatgctgtattggacatgcaagaatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaaga

SEQ ID NO: 132428 - DNA, 7457 bp, Homo sapiens
  Payload ID: 5860
  Gene Symbol: FAM199X
  Gene Name: family with sequence similarity 199, X-linked
  Uniprot ID: Q6PEV8
  ENST ID: ENST00000493442
  CDS Start-End: 167-1333
cgcaccccggcaagcagcagcgggccgcgacgcccagcctgccagtgagctgcgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaaaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaactatttacttaacggtcatcagtaaaaaaccctaaacaaggtcatgatataatttaagaccaattcccctactctcccaataatcacatagtcttattactttcaatttaacttgagtcactattaagcaagtttaccaaagtgccacaaagttgatttttaacgtttgtaaaggtttgaatgtttatagaagtgcatcatgaaattttgtgtaaatccagatgaactgtcattatagtactataaattagagatagtccataaagttgggttgaaggagattgaaaatatttcctttgattaaaagaaaataattaactaacttgggcttgcttgtgattgaagagggagattagatagtcctctgtccccccaaaaaagaaactagcagagaaagacataaaaagctctttggtgtctgttcatgtgctgtacattttttccgttttaatgtcttgtgtagataattcaaagtttgaactatttctttcttggaataagtaataatttattcaatatggtgtatctctgagttcaatttaaaacaatccaactcagtaatatttatttttaaatacaaatcctaactaaccaattaattaataaaaaggcaagacttacttgctgtagtattggttctcatctgtagagaactgacattggagcaaattttaagtctcccctttgaaaataagccttgttaactgagggcgtaatacatttcccacagatttatccagaaacattttattagagatcttatagtagtatctcagttcctactacagctttctaaaggatgagacttgcatttaacaaaatgacatatataatatttttctatagttttgcaactgaattaaaggaaggtgatgtattataatgtgtagtgaggtataaagggctagttcattctctcccaacaagaacttagaataaaataacacttttttttcatgagacttacctcatttttgttaggctatggcagttttgtccagttcctctgtcccttgagtgaattagatattggtgaattaatctcagaaactgacctataaaataatgactcattatagattgggtgaacttctcattttatttagcttttaaaagtgctaaatcctctcataaaggaaaaattataggaaactatagcggtatccagattctgatgagctttaaaaattataaaatatagcaaatgtcttcatattttagccagaaatattagtacacaaccaatatagaagtcttgtttgtttctgggttctccagcagagactttttgtttgtggcttactctgtatagcctcatgtgccttaaaggtggtgaactctagtttttgtcaatatcaggcttttcaaaactcaaaaacaatccaaatgttgtaatttgttttgcataatgcccatggaattggatatcagtaagcaaagccattaaatcgaaccaatcaatgctaatagagtataaaaacaaaaaccttcaaattttaagtttcatttgtgtaactttattttcggcctagctagatcattgaagagccttgaaagttatctaaagtatggcttaatgtatttttttccctctgaaaaagatcatatgccaggatacttcttcaaaccagatcacttttaatatctagaaagataattttcaaggtataggcaaaagcacttcaaggacagagattatgtagcaagttgattctctaggaattctttgaactcatttgtgtaatagctggaacacactcctcttctttcctttaacaaatgaacttttagcacttctgtcttcaaggaaaaacatttgtttggaattgaagggtactcgcagtccgtttatagtttgggacaattaataggaaaatccccagttgcattcaaataatagtgttgatgttgagggcactgactcattcagcatgtctgaactagaagtaaatttaattctgaaaggactgttagttaggaaataagtatttgtatacatatgtactgtggtaactttggattcattttaagtctgataaagtaagataaactttgtcttaaaaataaaattatgctaagtgaataaaaactgagatattttaagctaggcatctttgttagcatagtatccggaacataactacttataatgcttaggtcttatttctttggaaaataagttacttattccagaagccttagaaggaattctgaaaattcttctaactggccattaagagtaaggaagttgaatggtactgctgaagatctgagttgactcactgaaattttattttcttatttttttaacattaaaattatttctttttggctctccctctagttattttttaaattaaggtaattactgttttaacctagagcatataatggcaaattaaattttaatttgacactcataccgaactcagaaaagcttgtttgatcttctctaaattctgtatgtagtactttttttaattgtcacatttctttgttacatctttgtgtccaacaaaacctgtggaaatctgtgttcatttttgtggtgagggatgggggtgaaaaaggggagacttgctctaattatgcatatacatttgactatgtaaaggtagttgtagactatatgtataaataacaagttaacacttaatattctaaattgttctaaggaacagtggcctgaagccatgactagttttgtggagctgctggctcttttaacagtagctgacctattggatttaaactgagactgaaattgacatttgtggttaggttatctagctgaggcttttaacaatggagcagataatgtctgttcctgtagtggatccatttaatttcctatttgagtactctcacttaacaagtattatctattctgaacctttgtgttgggaatttaaggactattgtcaaaggctattaatggtaaacaagtatatgcaaaacaattcacatatgggtaaaaatttcaaattgtgggtttttgtttttgctttttagtttcaaagattagttatgtagcagcaatatcataaccaaagcaagtaggaagttgactggtttggagaatcttcaagtagttttaaatactgtaatgtatcagattgttaaccaggatttttttttcctgtattactgctaaatatattactatattaatgcacttttgtatatataactgtcttctgtacattctgtacttactacagtgtatataaagcctgttttccctgaagctgtgagggaataacaatagttgtatcataagtcgtttctattttgagttccttcttgtacttgaaagtagttcagtagtgaaatctaaatgagtgtgtatggttgtaattaaaactggcaatgtggcagagctgtcttttgaaactgaataccagaatgaaaagtgttgttttggttaagaactcttataatatattatttcttttgatgtaccctgagttgttacacagcccactcactgctgcttactactttatacttctgagtcagctcctttcatgctctatcccagaatatttaccaacagaggagaactgctcccttttctgtttctcacagtttggttatggctttataaacttttatttggtgaaagccccagatacccaaatgtcattggcaaaacttatttttttttctggacagatcagatttctagagagagcagatttctagagagattagcattcatagtaagtgaaaattgtctaatttttttaatccatgctattactgggcagtaggtctaattttttttgacaaaaaatagatctattttccttatatattgatttagaatcttaagttagaattttatagaagaaatgtctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaagcttgtttaatgatgccaatcttatgcttttctgtaatcttcaatttttaataaatgtgagttagatactaagtgaaa

SEQ ID NO: 132429 - DNA, 1642 bp, Homo sapiens
  Payload ID: 5861
  Gene Symbol: FAM20A
  Gene Name: family with sequence similarity 20, member A
  ENST ID: ENST00000590074
  CDS Start-End: 1-383
acttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcctcagttcctgcttttgaaaggaagagggggagtctgtgacccctgaggcctccttgcaactctgttttccaagctttgcacatcttccgaatttcttcttcaaagtctaccctaatgaaatatcagacaattttccaagtgtgcttcatgaacttctgggaggtgcttcacagtttctgcaaatgattgattgaattttcactttgaaaaaatatactttaaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctcc

SEQ ID NO: 132430 - DNA, 804 bp, Homo sapiens
  Payload ID: 5861
  Gene Symbol: FAM20A
  Gene Name: family with sequence similarity 20, member A
  ENST ID: ENST00000590873
  CDS Start-End: 1-66
cagagacacaatgctgagatcgcagctttccatctggacagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggata

SEQ ID NO: 132431 - DNA, 2955 bp, Homo sapiens
  Payload ID: 5861
  Gene Symbol: FAM20A
  Gene Name: family with sequence similarity 20, member A
  Uniprot ID: Q96MK3
  ENST ID: ENST00000592554
  CDS Start-End: 724-2349
gcagcgccggcttcggatcgggagttggccgtcagctgcgccagaggcaggtgccagcggagagtgggtgggggtgccggcgccaggccaggctcggggaggccccgcgctacctctgcctctaggagtccaggcgcacagacaagctccccggagccgctcctgcttcgccaactccccactcgcgccgcccgtgccagccgccggcactggcgtctccgccgcccgcaggaggagtcgcgggagcactagcagccgccgccgagcgacagcatcctcaggagagacgccccgggctttgcagccggcggcctccgtccgccctccgcggtcgccccccgccccgtcgcccgtccgcccgcggtggcagccggcgccggcgccccggggcccttcacctgccgcgagcgtccgggcgggcgggcgcacgggagaaaaggcgcaagaagcgggcaccccgggaaccccattccctcggctcactcggcgcggagaagcgacgcccgctgactccgagagccccggtgctccgtgcacctggtccccaagttgaggagcgacacccctccacaggggactagcccgcgcggggagcattccggtctcactgaccccggcccacccgcgggactccaggcacctcttctgcccgcaccccgcgacccctcccgggaccccggagacagccggcctgcccccggcgtcccccttggccagcacgccatgccggggctgcgccgggaccgcctactgactctgctgctgctgggcgcgctgctctccgccgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaa

SEQ ID NO: 132432 - DNA, 2798 bp, Homo sapiens
  Payload ID: 5861
  Gene Symbol: FAM20A
  Gene Name: family with sequence similarity 20, member A
  ENST ID: ENST00000619787
  CDS Start-End: 1-438
atgttcacttcaccaagtgaggggaaaccagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaaaataaaagagggatttgctaagaatatcagaaaaggagtgttccaatttgaagagtattacaattgaaataacatcaaatatgtcacactaagcagccagtaacagaataaataattacaacgaaggaaaaaaaaaggaaagtcctccaaggtcaggatggcatgggaacaggcctagcagggacacaagcctggagtaaggcaggaaaagagccaaggctgactacagcccaccaaccacaatcttcttccctaagaccccaggattgtccccggcccatccccaaaagaagaaaggggctatgtggaaaggtgaggccctctagatgcccctccctgtgacggctggctcaaaaaagactaagtcaggttttttattgaagcctcccttagaagaaagtgtagtagggattccttgtctcctctaccttctccctgacttgttgatatctgaaactccttttaataggaggctttgtttcttattccataattaatgaccgaaaacacaaaggacagtaaggtcttcattccatggagtgactagtcagtcaacaaaagtaaaaatgcctcatttcatcaaatcaacttttccagtaaaggccagagttcaaatactgtaagcatgagaatagaatggagctgtcactaaagagagtacaaggtcaagaaccagaaatgtctccaagctttctgcagtgtgagcaaagatagcctcgactggacaaataacacttctgaccccgtggtacccccacatgactggtatgctgcccctggactttgtgtctctctaaaatcactaccattcactgagatctgaccaggtgaggcactcaccaacgctacagaagcaacacacaggtttccaatcctctcaaacacagatacaacccccatcctccaatgtgcatggaagaactttaaatctcagagagagtaagcaaaatcacacaatttagtggtttagacctattccaaagtcttcttttcactgtaacacaaaacccaacagtatcccacccaatttatgaagtcaaatttgtttgcttaaaaaaaaaatcagctgggcatgggctcacacctgtaatcccagcactttgggcctaaacaggcagatcgcttggtctcaggagctcgagaccagcctgggtaacatgacaaaaccctgtctctacaaaaaaatacaaaaaaaaaaaaatttttttttaaatcaactctttaacagagaaaccttaatcccaaagatttccttaactgttgtggccctactgcagcatagggctccccacttcattcactgtctctcctgcttcaagatgtttcttccctgtggatgaagaaccaggagatcacacacagaaatgggaaaatatctgggtaaaaacattcaaagaatagcacaaaatggtttgggacttccaaataagactctcaggaaagcaggctacagctctacctcaaaacccgccacctcctataacgaaggactggttttccaatggcctatatacacattttgctgcactctacaaacagaaagcaataggcttgaatttcaccatgatatgtggtacacctaccttattattcacttatctttcaaccttccattactttttgattagtaacaaaattaagactcatttctcaaaaatatcagaaaaccaaccgtttcattcttactcgagttcttccagcatgttcattttgaactgtttacctcccatgaaataaaaagtctcttgactctg

SEQ ID NO: 132433 - DNA, 5984 bp, Homo sapiens
  Payload ID: 5862
  Gene Symbol: FAM20B
  Gene Name: family with sequence similarity 20, member B
  Uniprot ID: O75063
  ENST ID: ENST00000263733
  CDS Start-End: 337-1566
gtgtgggactgccgctctgcgcggcgagaggtggcctgggaatggccgggccgggggtgggccggagccgctgtggcggcggcggcggctgggggcggtgagcgcggcgtggggctgcccctccccggaggcggcgggggcggccggggccgcgccgcaccgcaccgcgcgggcggccatggagcgagcctagggcccgacaggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacgggacagagtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtcttttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcactctgttgcccaggctggagtgcagtggcacgatcttggcttactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcatctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctcatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaat

SEQ ID NO: 132434 - DNA, 603 bp, Homo sapiens
  Payload ID: 5862
  Gene Symbol: FAM20B
  Gene Name: family with sequence similarity 20, member B
  ENST ID: ENST00000440702
  CDS Start-End: 189-603
ggccgcgccgagcgagcgctgggattggccgtcgggcaggcgctacgctaggacggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatg

SEQ ID NO: 132435 - DNA, 2751 bp, Homo sapiens
  Payload ID: 5863
  Gene Symbol: FAM20C
  Gene Name: family with sequence similarity 20, member C
  Uniprot ID: Q8IXL6
  ENST ID: ENST00000313766
  CDS Start-End: 232-1986
gcggccgctccggagaggccgagcggggacgggcccgagatggcgcggggacccagcgctccggcggcgggcgccctgcacgcggcccgggcccggggacagccccggagctggtagccgcccggcaccgatggaccttgacccgcgaggcggcgccgcgctcgtgcccagctgcagctagaggggcgcgcgggcagaacgcgctccaggcccgggccggcccgcgcggccatgaagatgatgctggtgcgccggttccgcgtgctcatcctgatggtgttcctggtggcctgcgcgctgcacatcgccctggacctgctgcccaggctggagcgacgcggcgcgcggccctcgggggagcccggctgttcgtgcgcgcagcccgccgccgaggtggccgcgcccggctgggcccaggttcggggccgccccggggagcccccggccgcctcctccgccgccggcgacgcgggctggcccaacaagcacacgctccgcatcctgcaggacttcagctccgacccctcctccaacctctcgtcccactcgctggagaaactgccgcccgcggccgagccggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtcctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtggccatgaagtcggggggcacgcagctgaagctcatcatgaccttccagaattacgggcaagcgctgttcaaacccatgaaacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacaacatctgcttctacggcgagtgttcctactactgctccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtttgggaagtattcgcacgacgagctctccatcctggtgccgctacagcagtgctgcaggatccggaagtccacctacctgcgtctgcagctcctggccaaggaggagtacaagctgagcctgctgatggccgagtctctgcggggggaccaggtggcacccgtgctgtaccagccgcacctggaggccctggaccggcggctccgcgtcgtgctaaaggccgtccgggactgcgtggagaggaacgggctccacagcgtggtggatgacgacctggacactgagcacagagccgcctcggcgaggtagtgtccgccggccgctgcgctgcccgggacggagacagaggcgccggacctcccagcaagcgcatgcgcccgtcgtgaattcagtgaattcagaggcaggacgggatcatccggagtcgggagctgctgccacaggaggcgaggctccccaggtctcataggacacattttgtcagtgtttgaccagaaaagcttgggaaggaagcgctgtctgtgctcacggacagaggcggccggcgccggaggcattccatcctttctgtagggaaaggagcctttatttactattttgtatttatatttgatgaataagtatataaacagagacgtgtacacagatgccaatcacctaccaaaccaaacacgaggaccgccctccctggttctgggggcccctcaaggccaagctcacccctcaagtgctctcacactcgggacctaattcaagtaaaaaccctttctccttcctggggcctcggctcctggagggctggagggtctcgtctgaggacgggaggaggctctcgctggacgtctggcctgtgcgctggtggacggatgcctacgtggttttggaggacccgatgaccaggcgtcctgcgagtccgcccgctggcctgcagcacccacctcggacttggctgtggacggttggtgcaagtgcatcctgcagggctggctgtgcgcagctgtgggctgacctttgcagagttttgtggaatagtttgcaatgtcataaaagtgcaataaaggtacagcagatgtg

SEQ ID NO: 132436 - DNA, 1015 bp, Homo sapiens
  Payload ID: 5863
  Gene Symbol: FAM20C
  Gene Name: family with sequence similarity 20, member C
  ENST ID: ENST00000630666
  CDS Start-End: 232-1015
gcggccgctccggagaggccgagcggggacgggcccgagatggcgcggggacccagcgctccggcggcgggcgccctgcacgcggcccgggcccggggacagccccggagctggtagccgcccggcaccgatggaccttgacccgcgaggcggcgccgcgctcgtgcccagctgcagctagaggggcgcgcgggcagaacgcgctccaggcccgggccggcccgcgcggccatgaagatgatgctggtgcgccggttccgcgtgctcatcctgatggtgttcctggtggcctgcgcgctgcacatcgccctggacctgctgcccaggctggagcgacgcggcgcgcggccctcgggggagcccggctgttcgtgcgcgcagcccgccgccgaggtggccgcgcccggctgggcccaggttcggggccgccccggggagcccccggccgcctcctccgccgccggcgacgcgggctggcccaacaagcacacgctccgcatcctgcaggacttcagctccgacccctcctccaacctctcgtcccactcgctggagaaactgccgcccgcggccgagccggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtcctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtgg

SEQ ID NO: 132437 - DNA, 1015 bp, Homo sapiens; identical to SEQ ID NO: 132436
  Payload ID: 5863
  Gene Symbol: FAM20C
  Gene Name: family with sequence similarity 20, member C
  ENST ID: ENST00000633408
  CDS Start-End: 232-1015

SEQ ID NO: 132438 - DNA, 1943 bp, Homo sapiens
  Payload ID: 5864
  Gene Symbol: FAM200A
  Gene Name: family with sequence similarity 200, member A
  ENST ID: ENST00000408938
  CDS Start-End: 337-1943
ccggatgaggaactcggaggaggagctgggcccgcgcgtccatgattcgaaggctcgttttcgcagcttttccacgtctttttccggtcccactgccctccatgctaactcactgggcgtctctagccgttataccaacaatgactgcgaccagtgttgggaaagcgccccctgggcccctccctgacgccagcccatccttgagactccctgcaaggaggcggcccgacccagtgggatagcaaaacctgatctcataaaacctaggtcacaaaggacagccctgcaaaacagaccctatttggatcaagtgagccagttcctggaacctgaataatgactcctgaatcaagggatactacagatttgtctccagggggtacccaggagatggaaggcatcgtgatagtgaaggtggaggaggaagatgaagaagaccattttcaaaaggaaagaaacaaagtagagtcatcgccacaagttctcagtcgctctacaactatgaatgagagagccttattgtcatcgtatttagttgcatatagagtggcaaaagagaaaatggctcacacagcggctgaaaaaattatccttccagcatgtatggacatggtacggacaatttttgatgacaaatcagctgataaactaagaactatacctcttagtgataatacaatatctcgtcgaatctgtacgattgcaaaacatttggaagcaatgcttattacacggctgcagtccggtatagactttgcaatccaactcgatgagagcactgatattgcaagttgtcccacactcttggtttatgtcagatatgtgtggcaagatgattttgtagaggatctcttatgttgtttaaatttaaattcacatataactggattagatttatttactgaattagaaaactgccttcttggtcagtataaattaaactggaaacattgtaaaggaatttcaagtgatggaacagcaaatatgaccggaaaacacagcagacttactgaaaaattgttagaagcaacccacaacaatgctgtttggaatcactgttttattcatcgagaagctttggtatccaaagaaatttcaccaagtctgatggatgtattgaaaaatgcagtgaaaactgttaattttattaaaggaagctcactgaatagccgacttctcgaaatattttgttcagagattggagtgaaccacacccacttattgtttcatacagaagttcgttggctttctcaaggaaaagtattgagcagagtatatgaactcaggaacgagatttacatttttctcgttgaaaagcaatctcatttggcaaatatttttgaagacgacatttgggtaacaaaattggcatatttaagtgatatttttggcattcttaatgaattaagcctgaaaatgcaggggaaaaacaatgatatatttcagtatcttgaacatattctaggattccaaaagacgttattattgtggcaagcaagacttaaaagtaaccgccctagctactatatgtttccaacattattgcaacacatcgaagagaacattattaatgaagactgcttaaaagaaataaaattagagatattgttgcatctcacttctttgtctcaaacttttaattattactttccggaagagaaatttgaatcattaaaggaaaatatttggatgaaagatccatttgcttttcaaaacccagaatcaataattgagttaaacttggagcctgaagaagagaatgaattattgcagctcagttcatcattcacactaaagaattattataagatattaagtttatcagcattttggattaagattaaagatgactttccactgctaagtaggaagagtatattgctgttactaccattcacaactacatatttgtgtgaactaggattttcaatcttgacacggtt

SEQ ID NO: 132439 - DNA, 2480 bp, Homo sapiens
  Payload ID: 5864
  Gene Symbol: FAM200A
  Gene Name: family with sequence similarity 200, member A
  Uniprot ID: Q8TCP9
  ENST ID: ENST00000449309
  CDS Start-End: 381-2102
gtgacgcacttccggcttttgtgacgctttccctgggctctgaaggccagggggcttggatgtgagtctagtgctcctggtccccaaagtcacaaccccttctatcccagcatcccagacttctccgggcggggacagagttggacgtgcatggctgtgtcctgcaatcccctcgccacgaccgcccgggacggagtggaagcgggtccgtgcccccgttcctcgcgccagcctcggcggtggcaagcgctgtcccccagcagaggtgtccctggatacaggatagcaaaacctgatctcataaaacctaggtcacaaaggacagccctgcaaaacagaccctatttggatcaagtgagccagttcctggaacctgaataatgactcctgaatcaagggatactacagatttgtctccagggggtacccaggagatggaaggcatcgtgatagtgaaggtggaggaggaagatgaagaagaccattttcaaaaggaaagaaacaaagtagagtcatcgccacaagttctcagtcgctctacaactatgaatgagagagccttattgtcatcgtatttagttgcatatagagtggcaaaagagaaaatggctcacacagcggctgaaaaaattatccttccagcatgtatggacatggtacggacaatttttgatgacaaatcagctgataaactaagaactatacctcttagtgataatacaatatctcgtcgaatctgtacgattgcaaaacatttggaagcaatgcttattacacggctgcagtccggtatagactttgcaatccaactcgatgagagcactgatattgcaagttgtcccacactcttggtttatgtcagatatgtgtggcaagatgattttgtagaggatctcttatgttgtttaaatttaaattcacatataactggattagatttatttactgaattagaaaactgccttcttggtcagtataaattaaactggaaacattgtaaaggaatttcaagtgatggaacagcaaatatgaccggaaaacacagcagacttactgaaaaattgttagaagcaacccacaacaatgctgtttggaatcactgttttattcatcgagaagctttggtatccaaagaaatttcaccaagtctgatggatgtattgaaaaatgcagtgaaaactgttaattttattaaaggaagctcactgaatagccgacttctcgaaatattttgttcagagattggagtgaaccacacccacttattgtttcatacagaagttcgttggctttctcaaggaaaagtattgagcagagtatatgaactcaggaacgagatttacatttttctcgttgaaaagcaatctcatttggcaaatatttttgaagacgacatttgggtaacaaaattggcatatttaagtgatatttttggcattcttaatgaattaagcctgaaaatgcaggggaaaaacaatgatatatttcagtatcttgaacatattctaggattccaaaagacgttattattgtggcaagcaagacttaaaagtaaccgccctagctactatatgtttccaacattattgcaacacatcgaagagaacattattaatgaagactgcttaaaagaaataaaattagagatattgttgcatctcacttctttgtctcaaacttttaattattactttccggaagagaaatttgaatcattaaaggaaaatatttggatgaaagatccatttgcttttcaaaacccagaatcaataattgagttaaacttggagcctgaagaagagaatgaattattgcagctcagttcatcattcacactaaagaattattataagatattaagtttatcagcattttggattaagattaaagatgactttccactgctaagtaggaagagtatattgctgttactaccattcacaactacatatttgtgtgaactaggattttcaatcttgacacggttaaaaacaaagaagagaaataggctcaatagtgcaccagatatgcgggtagcattatcttcatgtgttcctgactggaaggaacttatgaacagacaagcacacccatcacattaaatacaaactttacaaaattctgtgtatagccaggtgtggtggcttacgcctgtaatcccagcagtgggagaccgaggtgggcagatcacttgagttcaagaccagcctggccaacatggtgaaaccccatctctactaaaaatagaaaccttagccaggcgtggtggcacatgcctgcagtcccagttacttgggtgcctgaggcaggagaatctcttaaaccaggaaggcagagattgcagtgagctgagataatcccactgcattccagcctgggcaacagcgtgagacttcatctcaaaaaaaaaaaattgtatttgtacttttaaagggattttgcagtatgttgtagttaaacgttaataaaattatatttgt

SEQ ID NO: 132440 - DNA, 2962 bp, Homo sapiens
  Payload ID: 5865
  Gene Symbol: FAM200B
  Gene Name: family with sequence similarity 200, member B
  Uniprot ID: P0CF97
  ENST ID: ENST00000422728
  CDS Start-End: 839-2812
ggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaatagctaacacagctgctgaaaaaattattcttccagcatgtttggatatggtgcgtacaatatttgatgataaatcagctgataaattaaaaactatacctaatgataacacagtatctcttcgaatttgtactattgcagaacatttagaaacaatgcttattactcgtttacagtctggtatagattttgcaatccagcttgatgaaagcactgatattggaagctgcacaacacttttagtttatgtcagatatgcgtggcaagatgattttttggaggattttttgtgttttttaaatttaacctcacacctaagtggattagatatttttacagaattagaaaggcgcatagttggccaatataaattaaactggaaaaactgtaaaggaattacaagtgatggcacagcaaccatgactggaaaacatagcagagtaattaaaaaattactagaagttactaataatggtgctgtgtggaatcattgttttatacatcgtgaaggtttagcatccagagaaattccacagaatctcatggaggtattgaaaaatgcagtgaaagttgttaattttattaaaggaagctcattgaatagccggcttcttgaaacattttgttcagagattggaactaatcatacccacttactatatcataccaaaattcgttggttgtctcaagggaaaatactaagcagggtttatgagctcaggaatgagattcacttttttctcattgaaaaaaaatctcatttggcaagtatttttgaagatgatacttgggtaacaaaattggcatatttaactgatatttttagcattcttaatgaactgagtttaaaactacaggggaaaaacagtgatgtattccaacatgttgaacgtatccagggatttcgaaagacattattgttatggcaagtaagacttaaaagtaatcgtcctagctattacatgtttccaagatttttgcagcatattgaagagaatattattaatgaaaacattttgaaagaaataaaattagagatattgttgcatctcacttctctgtctcaaacttttaaccatttctttccagaagaaaaatttgaaacattaagggaaaacagttgggtaaaagatccatttgcttttcgacaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaa

SEQ ID NO: 132441 - DNA, 1027 bp, Homo sapiens
  Payload ID: 5865
  Gene Symbol: FAM200B
  Gene Name: family with sequence similarity 200, member B
  ENST ID: ENST00000503617
  CDS Start-End: 955-1027
ttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctg

SEQ ID NO: 132442 - DNA, 4377 bp, Homo sapiens
  Payload ID: 5865
  Gene Symbol: FAM200B
  Gene Name: family with sequence similarity 200, member B
  Uniprot ID: P0CF97
  ENST ID: ENST00000622362
  CDS Start-End: 916-2889
acgcatgcgcagagggccgatccagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaatagctaacacagctgctgaaaaaattattcttccagcatgtttggatatggtgcgtacaatatttgatgataaatcagctgataaattaaaaactatacctaatgataacacagtatctcttcgaatttgtactattgcagaacatttagaaacaatgcttattactcgtttacagtctggtatagattttgcaatccagcttgatgaaagcactgatattggaagctgcacaacacttttagtttatgtcagatatgcgtggcaagatgattttttggaggattttttgtgttttttaaatttaacctcacacctaagtggattagatatttttacagaattagaaaggcgcatagttggccaatataaattaaactggaaaaactgtaaaggaattacaagtgatggcacagcaaccatgactggaaaacatagcagagtaattaaaaaattactagaagttactaataatggtgctgtgtggaatcattgttttatacatcgtgaaggtttagcatccagagaaattccacagaatctcatggaggtattgaaaaatgcagtgaaagttgttaattttattaaaggaagctcattgaatagccggcttcttgaaacattttgttcagagattggaactaatcatacccacttactatatcataccaaaattcgttggttgtctcaagggaaaatactaagcagggtttatgagctcaggaatgagattcacttttttctcattgaaaaaaaatctcatttggcaagtatttttgaagatgatacttgggtaacaaaattggcatatttaactgatatttttagcattcttaatgaactgagtttaaaactacaggggaaaaacagtgatgtattccaacatgttgaacgtatccagggatttcgaaagacattattgttatggcaagtaagacttaaaagtaatcgtcctagctattacatgtttccaagatttttgcagcatattgaagagaatattattaatgaaaacattttgaaagaaataaaattagagatattgttgcatctcacttctctgtctcaaacttttaaccatttctttccagaagaaaaatttgaaacattaagggaaaacagttgggtaaaagatccatttgcttttcgacaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttg

SEQ ID NO: 132443 - DNA, 975 bp, Homo sapiens
  Payload ID: 5866
  Gene Symbol: FAM204A
  Gene Name: family with sequence similarity 204, member A
  ENST ID: ENST00000369170
  CDS Start-End: 523-975
ccgccggttcgggctccggcatgatgagtctgggagggcctcttgtgggcagccgagggaggcggcatgggcggcctcatagctcctcggccgagcctcccggagcaggctagaaaagcccccggcccggggccgcggaagcgacggcggggccgccctcagccttcctcgaaaggggcgtcgcagcggcctccccagcctgttatgtggagggggttctccgtcccacccaggtcaaagtgagaggggattgaggaggctgtcgatagggaaaacaggctcacgtttacagttgctgtattccggaaaacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaag

SEQ ID NO: 132444 - DNA, 872 bp, Homo sapiens
  Payload ID: 5866
  Gene Symbol: FAM204A
  Gene Name: family with sequence similarity 204, member A
  Uniprot ID: Q9H8W3
  ENST ID: ENST00000369172
  CDS Start-End: 60-761
gcgatgttgacggggtcctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataag

SEQ ID NO: 132445 - DNA, 13889 bp, Homo sapiens
  Payload ID: 5866
  Gene Symbol: FAM204A
  Gene Name: family with sequence similarity 204, member A
  Uniprot ID: Q9H8W3
  ENST ID: ENST00000369183
  CDS Start-End: 261-962
gcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttctttttttttttttttttgagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaattttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtaccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccagaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtatagaaacctttcctctaaaaatccattatgggggaaatattcactatacaatccagtggttttgtctgaaatcctaaaaatgttatttttgagcaggcgagtggtatagatattctcacacttggggccccgatatgggcatttccctttgacttcagtctcatttttttttttttttctgtttctactccttagagcatttagtgacccctgcaggcatgttgcacttcccatactgaagccttgccagagtggcctcctgtagggtctgacttgggatcctgtccagccaaggaagcccttcttcagcctgctccagtgcccgcagttgccccctcagcatcccctcggggttctcatgtagatgggaacattttaactacgcggaaggcaggcatttcagcagaattaagtatagcgggggctcatctaataaaggaagccacttctcccaagtcgtcactcctttctgggcatgggttgtggaaagctctaaaacgttatgtgtagcagaagaaggggttggagggaagatttgtggggacaggttgtcttggattggccctgctgacatgtcatttgagagcagttttattttatcctttctaataggaattaggtattttactcctagaaacattattccttgagtacgcatgctgctcaaaggatgtagtcatttgtccactccattctagtcacagcaaaataaggattctttttggatcagtaataactttggttcctaaaacttcaatatgtgcatttactaccaccagaatgcctgagttagatcagtaatgtaaacgtcagttattgttaactgagattaatatgtttcaggccgttggtatggcattaatgtaactatgatttactatttaagtactttaggctaaaacatcttactaaagaacagtaattttgagctttacagcactggttctgagaaagggaagttggcagtgcattcttgtttgggagccctcaggatgtttctgattttcagcagaacattctatgtctttcaccgaaaggagagattgaatatataatcttaggtttgctataattagttctgatgacagagttaaatacctcagccaagactgtaaatcagtacgtaaacaggtttctgcaactgatcataaatctcaaactgcatattttaaacacttatttttttaggatgacagataagggagcagcaggctaaggataggaataaaatgttatctgaacttttaagtcacaacttagaactcacattaaaatcttctgattttctttataccttttgtctaaaatattatcttttagcttattaataactttaataagacaagtttgaatttaattcacaaaaaatgaagatataatttataaaatgtccaaatttttgttaagacattactttttaagaaatgtgtgtcttgctaaatataaaacatattgtatgaggttgttgtttaaacaaaatgagagttgtacattattttttaagagatgataaagtttgaggaggcaagccgatgttatgtcagatctcattttgaagttagtgaaacctagtctaatccagaaccaactgaatccaagttttccattttggcagaagttgcttttatttttagtatctggcagagcaacaaatgctttgcatgtcagttcaatattttttcctgccaactgtttattcattggcttaaaatttacactctactaaagtcttagctctgactttcatgaaacaaatagtaatatttggacaaaatatgtacatgaaaatctttttccagaaccaaatgtagactggtatttgtgacatcagtgccttctagcatggtgacgggtcgaaaaatactttgaaaagttgaaggctgtgtaaacccacggcagtgcatctcaagtgatttttattatgaggtaatcagagtatctaggttttcaaatttaaattagtgggtgactttatgctagaaagtagaatatgtgttagaataaatttatcaatatatattcttggcctttgtaggatactgagacaataaggtccatttttcatttttgaggttggggagctctgtagattttgataaaatgtgcagaactgcattctttaatctttattatttcatcctccctccacactgcttgctttaaaagaaaaaaatacctacacacattttctagtgttaactgctgtaatcagcatagacttcctgggaagggattcttgccttcagtaaaggacatgacagcatgtggccaatggagattgccacgaggaaacctggaaaggcattgaaccattttgtgctactgttaaaatgaggtgtgttgtctctttattatctcctactcaatagtgagtattctggaggtgtctgttccctttccggaatttcttcaaatacagagatgcttcagagtagcttcctgccacattggctttcatgatcttaatccctggaacacagctataggcttctgggagatagtttattaaatgccatgcagaatgctatgtttttagatgtgcatgtaaatcaagaattagctgaggaatatctttttattagtagtagtagtaactcatttttagattcaagtaaagtttgttttccaggtgagatgacatttttaagaaattgaatttaagtatgtgcttttatatccggaccaggtttctcaaggaagcagaatacaagggaatgaaaggggaagggagggtagtgcccaagagaaacctcggctcctaagtgctcccctgccaggtttcccccgtgcctgcccactggcaccatcctggcagctccagcccacaccccctcctggaccctgggctgcctctcgctgaatagctgcagggggcctgctatgtgacaggtatggaatgaggtaatccttttccacctctaatttctgaagggtgtgtctgtccagtttttacttgttcattgaatttaaagccttaggaaccaacagctacagtgcaagctgtaattattgatgtctgtttcatattcatctgtaagttctggcatttgatcaagaagtcaatatatcacttcatcttcaggctgaatgtgtctcagctataaaggttttattgtttgatggatagcatacaattatgactgcccacaataaaaagtgttttcatttgtaagatgggtgatactagaagtaattatgaatgtcacaaggaatagtgaaacaatgaagctttgcgtttctttgaatttctccctacataatgcccaaggaacatttcctgaatgcctactatatgtcagataaactaactcttgcagatgcaaggatgaataagcaaaatctaataggaaatatatgtaaaccatgttttgaacaactccattttcaggcgggctattagaaaatcagtgagtttttctttgctgaatacaaagacataatctacatataagaagtaatgtagacttaaaaattttagttacctgagtatatacttactgtacaggttgctgaatttcctagctaggcagtcagctacagtggcttatcagcttagtgactgatccatacttgctcacatcagagtgggtgggattgatgccctgactgtctcccctggagatgaggagcattggtggggtttgactcaggaatgaatgcaaatgtttgttctgcacattactcagtgattttaagcttaaagttttcttagactgcattaacgtgtcctttattttagcttgggtgggccacagtaccttcccatgttagggtaatgcttcctactactacaaatatgccccccaaaatataatgactcaagcacaatacaagcttatttcttgttcatgagacaaaggagaatgttgcttgctatcaacgagggctctgttccgggctgtcattcagagacccaggctgacagcgactcaccgccttctttccctagtaatcctggatgtcccctcgatgccagtcagctggaagggaaaagagcatggaagagcactggcgggaagttacgggcctggcctggaagtggaacacattagttctcactttgcactggctcagacttccttacttcatcacactaaccacaagggaagctggaaaatatagactgggaggaaagaaattttagtaaatagcttgcagtatctgccacattgcctcaatcacatacgatgtagtaactttacattttgctgatgttgagtagcacaaactactatttgtgatttgatggagtcatttttacttgggtgtgttgacagagctgagtcaaagtagctgttcatattaccgtgtagtgggtgtggtgtcacagtgtgatacctgctgaaagagcattgcatgctcagtcagtgaggcaaaggcagtgcttattatgccataaagggctgttgggactttaccaggtaggcgagtagaagcgagtgcatcctaggtagaaggaacggcgtggcacatttgaggtacagcaaggactttagcaggggccaggggagagaatgagaacagggaagtagagcagcagaaagagatggcgttgaaaagagctggccagaaccaactcacacacaactttgagagatgctggggagattggacttgtgcggggaagagttgggtgtctatggatggtgatgtgggatgaagaaggtagtcagagagcaggcttttaaagagtaatgttatattagtagtttagtaatatagagttagacatttagtatttagtaaagtaggtcatatttatacttgttgtgtcatggtacctgtggaatgccatggaaatgtcaaatggacacttctatgtagcaacctggaggtcagaagggagggaggttgcagaaataggtcgatgaaagaggtcttgaaaggtggcatgtcaacaggaacaaatgccgctgagctgtcaggcaagataatggtggagaggtggctgttggagttagcatcagatggcaccggtgatcttggccaaatcagacatccagaccagaattgcaatagatggtgcaattgcaatcttaggttggatttcctagaaacagtgcctcagatctcttgtggaggtgatttgtaaaagtatgcacttcaggaaacatttgtaagggagggagcaaagcccatgaggaaggggaatgcctgaaaggggtaaagccttggccttgtgctgggggaagagggctctgtgaactctgcttgtggcaaaggagctgttttttttctttttttctttttgagacggagtcttgctctgtcgccaggctagagtgcagtggtgtcatctcagctcacttcaacctctgcttcccaggttcaagcaattctcctgcctcagcctcccgagtaggtggaactacaggcatgcaccaccacgcccagctaatttttgtatttttagtagagacagggtttcactatgttggccaaggtggtctcaatctcttgaccttgtgatccgcccacctcagcctcccaaagtgctgggattacaggcatgagccaccgcgcccggctggagctggcttttaaacccggtatcagtctcagtcagtcagtcactgcaggccagcattttacatgggatgaaaggagggatggatggaaggggtggaggatacatacctggtccttccagttaaactatttaataaataatcatgactgagaatataagccttagaagtactgttattgttctgtaaattttttaaaaacactttgaggattcattgttatttatgctccttgccttggagggacatcttggttctacatatgtataaatgtctagcagattgaaaatctgaaattcttctttcattactcttcccatacagtgctcttgcactattcctctaagaaagccaaagacacattatacttgttttttagatgaggaaatcaaggtgctgggaagtttaagagaactctacagccattcatctagcataaaagggctgacgttagaacgcaggccaggcctttgcctcttccctaccccattccagtggttcttgaagtgggatccatgccctcctgcaagcagaatcacttgttaaaaatgtaaactccagggtccctctctgggggcagggcctgggattccacattttcaaaagctcctctgtaattagtgcatacaaagaagactcattgtcttggagcagcacccgcttcttacacggggagtctgggatgggaaagaggaaagcaagtcagtgcaacttgcacatgtcttatcacaaaccatagggaaggaggtgccttgtggtataaatactgagtttaatgccattaatataaacgctcatattcccaaacagactgcctgtactagtacattacttccattttccaaaaaaggaaaagaaaggttccgtgtcaaagaactcaattggaatcctcgcttggtacttgcttccttgccagcagtgctcaaaaagagaaaaagaaaatccaaagtccatgtacataaaagttccattcccgatggtggagggcttaattaaagtcctcagatgtttctgtgcaccttggaaaacatttttatgaaattcatatattaccagaagtggctccaacaattcttgcagttaaaaaccttgtaactcatgcagctccatcaggagcaagctgcctttttcaagatttgttttgctgcttcctttacctccgtagcctgtggcagtgacggctgctcaagggccttaactgccaggatggcactagaggattttccaaggttaaggtcagataacagaatctggaagaaatggatccctcttcctgcatttccttttctcattatttcaataaatgcattgaaggcttgtgatgtgtctggcactacagcaggcactgaggatgccacgctgaacaaagcggctggatcttcatggggctcatatcctagagggaaagacataataagcagactctgcagtgtcacacaacatcacctaggaaatatagagatgcaagtgctcaggcgccaggccagacgtgaattcaactgtggtagcaagaccttgtatcttctgatgggacgttgaagtgtgagaaccactggactctcatatggtgataaactttggagaaaaaggacggaggcaggtgtgttgctgatgccagcaaatgttagaatagtgaaactgctacaccctggactatgaagcaagccagatttgaatcccagctctgctacttacaagctgtgtaacctccggcaggctacttaatctctctgtaccttgggttctcctgagaaatggagataataatagtagctatcttatagagatgtgaggattaaaggaactaatgaatatgaaagtgctgagaatagattctcacatatagcaaacaatatacttgttgggagacaattctctggacaattcttgcatttctacacgtcttggaagcaaggcactaagtacccttttgttccaaactatctttgcaaggatgtttgtatataacatccttggaagattgagatagtgtctcactctagagcaaagaacagacatgcttactcccattacaaaagattcggtttcctaactcagagttcctgttcttgaatgaaagtcatgcagtatacaggtgtcttttggccctcttaactgtcatactgtaggaatcaatgcaaaaatgctgatggctatttctgttgtgagtaaatgtctgaactgagagtctagtgtcttctatcagcatttgtaaaactggccaactgacttgctaagttgcaagtagggtgaaatctcagacccttcgtagtccttgacaattctgtgaaagtgtgtaagtgtttgttagtactaatgttgttattactccacagtacgtgccaattttctggaagaaacaaaaatgtaattgatggccctagccttcaaagagttcccagttgagccaaggaggttaaatatgcgaagatgacgcaaaagacatacagcagcaggaaagcaaagctttggaatgaaacttgggtttgaatgtaggctgtggatgctcaccagctatggcaactctgagcctcaacaaatttctatttgtaaagtgctgttgttaataatgcttactgtgtgaggttgtgaacattaagatagtgcatggagagagcttagcacgggtctggcatgcagtaagcactcagttaccattactgatgttgctgtattgcatttgtgcttaggatacaagcagagcactttctctcccctccctgggtctttagggaagtaaggccccagtactgtacttcctttcaggtggaagctgctttccttggaaccaccaaaccccaactcagtatgtccctggattctgcccaaagaattccccagggctaagctcctataggtgggtggctaaaggactggcttcagagtcagacagctctcagtggatatatacttagagatttaatatgatatatactgctttgaagtttatgtggtttttgatgattttattaatgtgcataatagtcctagcatataatatgtgttcagccaatgttaatcagtgccctaggctacaccaccatgatctaatgggccattcaattttcatgactgtattcctaggatatttctcaatgactcatacatggtaggtgttcagtaaatatttgttgatttaattggcttgagtgaacaaaagaagtaatacgtcctttcatcttttctttcaagatatttctgcattaaatcatcctcagtatatttttttgaaagccaagttttcccaaagctcctcatttcctcatctccctctgtgccactggtttttcagttgctgggggctacagaccctctctctagaaagatggacatgtgaacataagcactgcattttgcacacaatttccgtggttcagaaaccacctgaacttttccttctagaggaccctgcttaaacacttccattctagggtgtccagcccattaagatggccaagaaatcacatcccactcatctcccccaaatcagcaagctgtcatggacggtcctcaatacagttgctactttgttcctctataatcaaggccacacaagacccacttccaatctacttgtgatttagggatagcaaaggattaaagcaattcaagtattttagattcctattgatagcagaattgtggttttcaagacgtgctaatggaaaaattgttagtaaaaataggttcatgcagtcttattgatcatgcttgtaattctgaagattccacttgtactttttgtaaccatatttctcttctcttccattctctagttgtgagaaaacccagttgtccaataattgtcaagctttcctcggccttagggaatgagcactcaagacctttctgggccaagtgtggtcgccgactcctgtaatcctagcactttgggaggccgaggagggagagctgcttgagcctaggagttcaagactagcctgagcaacagcaggacttcatcactacaaaaaataaaaaattagccatatgtggtggtacacccctgtagtcccccagctactcgggaggctaaggtgggaggattacttaaacccgagaggtcgaggctgcagtgagccgtgatcgcaccactgcagtccagcctgaccctgtctcaaaaaaaaaaaaaaaaaaaaaaccttctggaagcagaaaggaggaggttttccaaaaccaaatcatgtcaagtacctagcttgacctcaaaaaaaaatacagaagcagggttggtaattgattgacaggaagggcagctcaaagcaggaaatggagagtggtatgaaaacacttaagcagtactgcccaaaggaagaacctgaaaagttcagccatagattttctgagaagatgaaagtgtaggcattagcatactcaagaatcaggcagacagttttccccatttggaagctgaaaaaggaatgatctgctgcccaagacaagaaaatgatgtgggcccagagggaaccgtcactcacacgtacactgtccagggggccagagaaggattacagccgccattttggcttctctagagtgaagcagcaaaacaatgtctagtggttgctaggcaaccattagtccatcgctgcccttttccattaaacattatctgccttcttagattgttttatttttttaaacaggataggtaatgcaacagagaattaacggtgcaacctaacaatgaaaacgcatttgaggttcccgaatcagtgaaggctttgcaaaggttagatcactcttgggtggatgccgaagatagtgacagttgactgaaacctcttccccagacatttcatcactggtcctcatgtttcctagtgccaaaaataataatgtggacgtaacaataatctctgtacattgtaaaatgtctgtcctctgctacgacctgctccaagctagatcttgtcctgaagcaagtttctctatcggcaaagagtggatgtcagaggtggtaaaatggagttctagccctggtcagctttgcagatagctaagatcatggtatccaaagaacctgagcaaaagtacatggaaataacacctgtttatgcaaggaacgctttctgacacataaaaatgaagagtaactggtaggagagaataagcgtctttattcagatacacatcgcattcggattttaaacatacctaatgacttttacaacaagaggacactgaggtacccagaaagagggtggaaaatcaggatgaagggagttactgctagcctgtcatgtaccatgcacacaacctatctttttaaataccagtggatttcctgtctggctcagggggcctgtctaggaagagattcaaggaaagtagatgggttagttccagggactggggctcaaaaatttaaagccacacgtaacgttagctctctcactcccacacacatttaagataaaggagatggcagtagtgtgctgcccagaggatggaatacgcagataactaggtttctatactggttctactcactagtctgatcttgggtaattttttgggtcattgttctgtaagggagggcaataataactacttggtcagggctgttgtgacaattcagcaataaaacatggtcaattgca

SEQ ID NO: 132446 - DNA, 1000 bp, Homo sapiens
  Payload ID: 5866
  Gene Symbol: FAM204A
  Gene Name: family with sequence similarity 204, member A
  ENST ID: ENST00000470476
  CDS Start-End: 55-714
gttgacggggtcctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagaggaaaatcatgggagtaatgttgtgtgtttctcagtgtcagcgatccagagactcgtgctgtctctttgtccctttcctgatggtgttacttcgattaactacttcagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatca

SEQ ID NO: 132447 - DNA, 4225 bp, Homo sapiens
  Payload ID: 5867
  Gene Symbol: FAM205A
  Gene Name: family with sequence similarity 205, member A
  Uniprot ID: Q6ZU69
  ENST ID: ENST00000378788
  CDS Start-End: 41-4048
atagagggatggttgatctcatgctaatgaagtttagaccatgttgagccctacttttgttctgtgggaagttggatatcccttatacatctatggctccatcttcatcgttattgtaattatctggcaagtgaaaaggagccaccatgaattgagttcagaacctaaaaggagctgctgccggtgtcaccaaaaagtcaggcaaagagctagagatgcagcatcaacagctaggagacgttcccgggaagaagctgagaagccacagaagctgctctccatcattaaaagccagggctggcttcctctggagagaagtgtgcggcgaatcctgtgtgcagatccctgctgccaaatctgcaattctgtggctctggagattcagcaattgctggtgggtgagaacaaccagatctccctgactttatcggggccattgcagggctcctcttgcctagagatgctgtctacgtctagtatgtctttagatcagagtctggagtttcattcctggcacaccagagagctttcactgtcatctgtaaccccaacactgtcacaattaacagatcagaaatctttaacccagtcagctgcccagtcaacgtatgcagatggcatacaagattactgggctgatcacctccagctagggcaggaatttcaagtgccagatgtgctccggggcccaaacaccatagcttcttcaaggattgagaagccaagggctccactgaaccaggaggagatgacgcagagcaaccccagccttgtccagggaaaccaaggccagcatcacttgaattcccaggtctccttgctgtccctgaacccagaaaccctgaaccggatgcatccaatggccttgcatatggtcctccctgcccacctgccatttctcagtcctgaagtgctgaggcttcttgaggtacatgttaaaaaatggatgcatttccagaggtgggggctcccaagacgtgtggaggagtccctgaggcagcttatgccaaacccaccattgtattaccaacctggaaatgaccagccagtttctttcaacctgaagaatactcctcaggtctctcttcatagatttgagaccatttccctccagacctggtgttcatgtgtggctggccagcccatccagaccttctgggtttctgaatggtccacaatgaacccagaacaaagacaccactgtcagcaaactccaaaccctatggctctagccttgccctctccagcccttaaagccctaagtggcccccatccacagtctgggggacaagataatgactcagggagtgatctccagcagaaatacagccagctattctgtgggctcccttctctgcacagtgagtccctggttgccactttcatgggatctcaaggcctccccaagattgaaaatgtgcccaagccccccttgaaggatccttttctcttcaatgagctctccttcccccaactgctccctaaaacttcaccccagtcagccccaccctcttccccactttccccaaactggatgtctccatctgaccatcaacgagctcagatcaatgtcccatttctgactctggctgagtatgaagccttggagtggcacctgctacagaggcaactccagcttcagtggggctggccagctgccctccagaggtctcagcacacccagtgcctcatgcagcatgagccctgtggcaaagctcagtctcctgagaccacgacagcttcccagacagggaagtccatctcagtgctcaccagggaactactcttcttcccggagcatgcccggaagctgctggaattccacatccagaaacagttgattcgccatcgctggggcctgcctcagaagatccagcagtccatccagttgctccttacctccactgatcagcagactgtgtccagcagcagcacagccctagccaacgtgagcatcccccagcctgtagccctagaggccaacggggcttgcgatgtgctgtcacccattgcggccccagtgtccatccccaggccacacttgttaactcaggtcaaggcaatactgcagagccacatcgactccaaatgtggacaaatccaccagggcaagatccccgcctgtgtacacaggtcctgggactgcagaatttctggggtcctggcagtggctccttttccctgcattccagaaagccagttcctggaactgcagacagcaagtgacccggacctgcatcacaaagttatgccctggatgccaacggcccttgatcagcagcaacaggctttaccaggtactgtcactgaacaccctaagctgctccgagtcttgtctgtggaagccattgagaaactggagacaactttacggcacaagcatctggccttcctgtcggggctgcctgctctgtattatgtggcgctccccagggccctggccccggcagtcactagccaatctgtcatcacagagatggagcctagtcccgtggaaatcccagcagagcctctgattcagatggtttcatttgaagaacagtgtataagtcttgggccatgccctcaaggcaacaatgagagttgtacagacgttgcaaaagagttccagcctgcagtgccagtaaaaggaacaatggagacgctgcctctagaaagccagacgcatcctactagcccccactcactccagacacatatcttgaccaaactaaacttccacctgagaaaaaaggtcctagagatacaatggggaattcccattagggcaaggaagtccagggaacaaactgttgcagcaccagagaacatatccacacagaagtctcttgaaagtctaaaccaccaaggggagacattgctccaggaactgcccatcccaccagacactcttcctgcccctaatccagaaggggttcaccttaaagaacagctggccaatgacttgaaggcagtgcagcagaaccaaaagcaatccaattccaaagctgtaccccagggttctgcccactcggtctccaagatctcacagcccagtggggacatgacagaggcccacatgccttgtgttcaggtagaggccaatgtgaacaaacccagcctggaggaaccctgtggccctgagcctcaaagccctagcaagagcaaggacccagcccatgtccccatgctagcaggaaacagagaggacccagaggaaaccaaagcagccagggaccacagagaaggggatgcggggtttgggcgctcctcaaccagagaagagagacgccctgctgaagaccagaggccagcagggatgcttccaaacaagacaccccgagggtcctggcgatggagccgtagctttcatcttgctgatccctgtcaacacagcccccagcatcaccctcagcttaagctcccacagctacctccacgagtccctggggagaaagagtctgagaaggacctgcaagacagtcaaaccaagctaactgtcatccttgaaccagcgacaattcctgagaatgcccagactgtgttgccccaggcttcacagggtcagcctttcctgagccaaccaactcaggctaagcctttgcagggccaaactttgcaaggccaagttttgcatgggctggtgatgccagtccatgctcaaaagaagcccagccttacagagtctagcttcagaaataaaattaaatgttttctgcagcatattaaccccaagacaaaaggcaaagggcatgaggactccatgttctcagccgctgcgaaggtggccaaaaccagaaaagaaaatgttgcaaagagcctggctccagccaagagccctgtggggagaagtaagacggagaagccgacagggtgctccaaggcccaatctcgtcctgctcagaagctggtgggcccagccttcttggatggtccccaatccctagacgataagctccggctacactccagacaacctggctctgcctcagccctgggctacccccgccactgccctcgtcactgtcctcgagaggcttgtgccaacaaaccagggcacccaacctagctcctgaccctcacctcagatagaaacattggtccgctcaaggagaacatgcagagccatgaaaaagagtttataggctccccaactgctgcagccctccagaggaccagtattgtcatttccataaatgtgcaggtgggacagatgccactagaaatacactctatatttctcagc

SEQ ID NO: 132448 - DNA, 468 bp, Homo sapiens
  Payload ID: 5868
  Gene Symbol: FAM205C
  Gene Name: family with sequence similarity 205, member C
  ENST ID: ENST00000603592
  CDS Start-End: 40-426
gaaagactagggagagggatggctagtgaggtttagatcatgttgagccctacctttgttttgtgggatgttggatatcccttatacacctatggatccatctgcattattgcattaattatttggcaagtgaaaaagagctgccaaaaattaagcttggtacctaacaggagctgttgccggtgtcaccgaagagtccaacaaaagtctggagatagaacatcaagagctaggagaacttcacaggaagaagccgagaagttgtggaagctgctgtttctcatgaaaagccagggctggcttcctcaggaaggaagtgtgcggcgaatcctgtgtgcagacccctgctgccaaatctgcaatgttatggctctggagattaagcaattgctgaagctccagaagttggcttggataacaagatgaagctgtttctgcactggattaaccctgaaatgaaagatcgaa

SEQ ID NO: 132449 - DNA, 983 bp, Homo sapiens
  Payload ID: 5868
  Gene Symbol: FAM205C
  Gene Name: family with sequence similarity 205, member C
  ENST ID: ENST00000340783
  CDS Start-End: 57-683
ttaggttctaagacagtgaaagactagggagagggatggctagtgaggtttagatcatgttgagccctacctttgttttgtgggatgttggatatcccttatacacctatggatccatctgcattattgcattaattatttggcaagtgaaaaagagctgccaaaaattaagcttggtacctaacaggagctgttgccggtgtcaccgaagagtccaacaaaagtctggagatagaacatcaagagctaggagaacttcacaggaagaagccgagaagttgtggaagctgctgtttctcatgaaaagccagggctggcttcctcaggaaggaagtgtgcggcgaatcctgtgtgcagacccctgctgccaaatctgcaatgttatggctctggagattaagcaattgctggcagctccagaagttggcttggataacaagatgaagctgtttctgcactggattaaccctgaaatgaaagatcgaaggcatgaggaatccattctcctttctaaggctgagacagtgacccaagacaggacaaaaaacattgagaagagtccaactgtcaccaaagatcatgtgtggggagctacaacacagaagacaacagaggaccctgaggctcagcctccttctactgaggaggaaggcctgatcttctgtgatgcccccagtgcctaaataatctgctctagcaacactcccttcagtccagccaatcctgggtcctgtgccactcctacaaatgctccaaactctgtcctcaaatgacttgtgccactcaaccaggaaatctatcccaggtctaactcacctcagcagaaggcactgttttatgcaagaatacccatcacaagaaaaaggagttcataggttcctgaacctctgcaatcccctgaaaaaggctttcattgccatttccattaacatgcaggtgaagcagggcattctccaaatatactttgtacctttaagcaaaga

SEQ ID NO: 132450 - DNA, 1017 bp, Homo sapiens
  Payload ID: 5868
  Gene Symbol: FAM205C
  Gene Name: family with sequence similarity 205, member C
  Uniprot ID: A6NFA0
  ENST ID: ENST00000603640
  CDS Start-End: 1-1017
atgttgagccctacctttgttttgtgggatgttggatatcccttatacacctatggatccatctgcattattgcattaattatttggcaagtgaaaaagagctgccaaaaattaagcttggtacctaacaggagctgttgccggtgtcaccgaagagtccaacaaaagtctggagatagaacatcaagagctaggagaacttcacaggaagaagccgagaagttgtggaagctgctgtttctcatgaaaagccagggctggcttcctcaggaaggaagtgtgcggcgaatcctgtgtgcagacccctgctgccaaatctgcaatgttatggctctggagattaagcaattgctggcaggtgagaacaaccagatctccctgacttcactggggccatcacagggctcctcttgcctagaggctttgtccacatctagtgtgtcttttaagcatagtcaggatctgggctccccgaaatccaaagagctttcactggcatctgtaactccaacactgtcacaattaatggatcagaaatctttaacccagtcagctgcccggtcagctggtgcagacagcgtccaagattcctgggctgatcactttcagcgaggacagagatctcaagtcccagctgtgtcccaggtcatgggatctctgtcttcaaactttgagaagcctggaattcctctgagccagcaggagaggacgaaaaacaactccaaatttgtcctggagaaccaagaagctccagaagttggcttggataacaagatgaagctgtttctgcactggattaaccctgaaatgaaagatcgaaggcatgaggaatccattctcctttctaaggctgagacagtgacccaagacaggacaaaaaacattgagaagagtccaactgtcaccaaagatcatgtgtggggagctacaacacagaagacaacagaggaccctgaggctcagcctccttctactgaggaggaaggcctgatcttctgtgatgcccccagtgcctaa

SEQ ID NO: 132451 - DNA, 2134 bp, Homo sapiens
  Payload ID: 5869
  Gene Symbol: FAM206A
  Gene Name: family with sequence similarity 206, member A
  Uniprot ID: Q9NX38
  ENST ID: ENST00000322940
  CDS Start-End: 307-852
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcgggggggggggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaagaaatcattcgatg

SEQ ID NO: 132452 - DNA, 499 bp, Homo sapiens
  Payload ID: 5869
  Gene Symbol: FAM206A
  Gene Name: family with sequence similarity 206, member A
  ENST ID: ENST00000374624
  CDS Start-End: 1-348
atggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgggaaatttaagcggagaattatctatctagaaaaggtagaagacgtcatcaagaggaaaatgatgcctctaagcttgggactgcatcttccccactcttaatcctccttctataggaaggaatcttcacgagcacaggatccctcacttctgtctgctgcctcacctatcccatcccataaaaggaggtggatgctcatcttttcagtctttctggtgactttgcaaaaataaattgaacacattaaccctt

SEQ ID NO: 132453 - DNA, 389 bp, Homo sapiens
  Payload ID: 5869
  Gene Symbol: FAM206A
  Gene Name: family with sequence similarity 206, member A
  ENST ID: ENST00000445175
  CDS Start-End: 1-389
atacttcactcgctggtacaaaccggaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaaca

SEQ ID NO: 132454 - DNA, 927 bp, Homo sapiens
  Payload ID: 5870
  Gene Symbol: FAM207A
  Gene Name: family with sequence similarity 207, member A
  Uniprot ID: Q9NSI2
  ENST ID: ENST00000291634
  CDS Start-End: 49-741
ccagcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcgggcatgccacaactcctcaggacacatgtgggccaagtagagagcgccggcccctcaaggaccatggcctgagcctggtggacgcccttccctctggtcggttgtggggctcaataaatggctctgtgaacttcccctgcactgccagggccgttcccatgagctgcttccctga

SEQ ID NO: 132455 - DNA, 880 bp, Homo sapiens
  Payload ID: 5870
  Gene Symbol: FAM207A
  Gene Name: family with sequence similarity 207, member A
  Uniprot ID: Q9NSI2
  ENST ID: ENST00000397826
  CDS Start-End: 47-694
agcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcgggcatgccacaactcctcaggacacatgtgggccaagtagagagcgccggcccctcaaggaccatggcctgagcctggtggacgcccttccctctggtcggttgtggggctcaataaatggctctgtgaacttcccctgcactgccagggccgttcccatgagctgcttccctga

SEQ ID NO: 132456 - DNA, 643 bp, Homo sapiens
  Payload ID: 5870
  Gene Symbol: FAM207A
  Gene Name: family with sequence similarity 207, member A
  ENST ID: ENST00000458015
  CDS Start-End: 34-643
cgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagaaagcaggggctgtgtgcagtgtcaaacctggggtccatcctttcatggcccagctgcccaggctcgagggtggcaggtcacgcgctgcaggcccaggcagctccaggctggcatcccgcggcggaggcaccagagcactgggtccagaatagga

SEQ ID NO: 132457 - DNA, 5239 bp, Homo sapiens
  Payload ID: 5871
  Gene Symbol: FAM208A
  Gene Name: family with sequence similarity 208, member A
  Uniprot ID: Q9UK61
  ENST ID: ENST00000355628
  CDS Start-End: 232-5061
agaagaactgcccgagggaggagcggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacata

SEQ ID NO: 132458 - DNA, 7119 bp, Homo sapiens
  Payload ID: 5871
  Gene Symbol: FAM208A
  Gene Name: family with sequence similarity 208, member A
  Uniprot ID: Q9UK61
  ENST ID: ENST00000431842
  CDS Start-End: 926-4627
aatgactgttaatttctttgcctcctctttgattccatctcttgacctctatatcatttcaaaggagcattgagtgaacatccatccttgtaccttgaatattccatgaatgctcctgcttcagggcctctgcatttgctgttctctcactttccccagtaagctgcataattcattctacatttcttcacgtatttccttatgattgaggtttctctgttttttttttttacctctatactcttatgtctctttttatagcactgaaaaccatcatgatctgttatatatcattgttttctgtcttcctcattagatttatgtaggttggaactttgttctgtttatctctataatcctattacctagaactgtgcctggtaaataagagcttagtatgtatttactgaatgatgaattaatatatttatatattgaggctgtgtcttctaatgtcagcaaaataattgacaagagactttggtggacactgttctctcttggttaatatttttggaaaaaacaactcccttaaatttgggtaaatgtggtaatttgagcgaagtaagtacttctgttttctctaagtagacttggatttactagactttgtaatgagtaatttctttgttcttcctacctggaggaaggacttaactgtagtatgccattaaaaattgcacttatatcatcttacatgttaatttttatgattatactaatgagtaatgtttttcttttcttttaaaaaatttgtagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgttgttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacg

SEQ ID NO: 132459 - DNA, 5600 bp, Homo sapiens
  Payload ID: 5871
  Gene Symbol: FAM208A
  Gene Name: family with sequence similarity 208, member A
  Uniprot ID: Q9UK61
  ENST ID: ENST00000493960
  CDS Start-End: 12-4550
aggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccaggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacgg

SEQ ID NO: 132460 - DNA, 3441 bp, Homo sapiens
  Payload ID: 5871
  Gene Symbol: FAM208A
  Gene Name: family with sequence similarity 208, member A
  ENST ID: ENST00000614531
  CDS Start-End: 159-3266
cagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaac

SEQ ID NO: 132461 - DNA, 8626 bp, Homo sapiens
  Payload ID: 5872
  Gene Symbol: FAM208B
  Gene Name: family with sequence similarity 208, member B
  Uniprot ID: Q5VWN6
  ENST ID: ENST00000328090
  CDS Start-End: 626-7918
gcttccggttgctagcgccggtcagagagaaagtcggcatgttctcgcaggctgccgggcgtcccggggttgcctcttgcccgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgaaaagcaggtgtatacatttccaaatactccgactgtcttcattcaagaccatggtatcatgggaaatctggttatgttgtaatttttaatataattaagtattacttttacgaactttcaggcaacaccgttattgaacgacccagacagatctgtccttatgtaattgtagcttttcgatacagggaatctaaaactatggcaccaccagctcataaaagcatacttgaacgcagtgaaaatgttctcatgtctccatggaaagggaaattaattgttcaagaccgtatgctatgtgatatagctctttggtccacttacggtgcaatgattccaacacagctaccgcaggaactagattttaaatatgtaatgaaagtgtcttccttgaaaaaaagactaccagaggctgccttcagaaaacagaattacttggaggagaaagtctgttttcaagatttgtgcttcaatttgtatgaggtagaactgtcaaacagacaaggggaaaatatagataaattaacagaatgtattaaaaacaagcaattggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcaaagaagagagtttttccattgagtccagcgtcaaatctgagagtgcagcctaagaggaaggccagcatgccccacatggtgcagagtaaaaaggtgaacttgtgccgcccctttcccaaaagaactgcttccagagcagacaacagctcggactctccaacaactcttaagttagttaaaggacagtttcctcagaaaagaaaaagaggtgcggaagtgctgactgcacagtttgtacagaaaaccaaattggataggaaaaaccaagaagctcctatttctaaagatgttccagtgccaacaaatgctaaaagggcaaggaaacaagagaaatctccagtcaaaactgttccaagggctaagccacctgtgaagaaatctccacaaaaacagagagtaaatatagtaaaaggcaatgagaaccccagaaacagaaagcagctacaacctgtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttccacaccagtatctgaggctagaaatcttcactgttcctctgaattgccacaaaatgatgttttgctctctaaagaaaattctttgcgaggtacatctgaccatgaatatcatagaggagttaaaactcaaaaaggtgaattactacctaacccatcttctgataggaagagtaattctggatcagacttaacagttagccaagatgaagaaagcttggttccttgtagtcaggcccctgctaaagcccagtcagcacttactgaggaaatgctagaatcttcagatgcaagccaaagctcttctgtttctgtggaacattcatatgccctgctccttacagaacattcaaagaaacatctacaggagagagagatactaagccctctgtttcccaggaatgggacaaaaagccctgaagcagcaaccccagtggggaaagtcatgccatttcggcatcagcccggccttttgcttcagcaaaagcctcctgacgaccccgtggtgaagcccaaggatcgaccaccgtctgcccgtgtgaaaaaatcttcttgctctcgtatagtgcttagctgtgatgactccgttaagatcactttcaaatgtgaaacagaatatgcattcagtttagacagcaaatataccaacaacccactggagaaaactgtagtaagagcattacatgggccctggaatactgatttgcctgataatgtggaagaagtgaagcttttacttcatatgtgggtagctctgttttacagcaatcagaacaaaatcatacgatcttcccgaaaggttgtagaacacagcaacccagcaaaatatgtgtctataaatagcacgttagaatcttgtgagctccgtgaaattgaggagtcccttggtttggaaaaatgttctgcagactctctgttggagactaacgaaatttccagggctcatgctgctgaagtatccttccgtgatcctaactgcttgcttcctttcattaaaacaccacttacccaaggcttggaactctgtgtacaaaatgaacagaaaaaaacttttgcaagagagtgtgatccagacacccaagaagaccagaatttcatctgttcttacaataatgaggtaactggggaagaagctaaacaagaatcattggagacttctaatcttgtgctttcgggtattggaagtacacaaactaatggaccttctgttcctagtgaagaagaaattgttcagccactggatagcacaagagtggcttcttacagtggcactgttactcaagccacattcaccaggacttacgatgggcctggcagtcagccagtgatatgtcagagctctgtgtacggcacccttgaaaacaaagtggatattcttgatgcagcagtgcaaacaaaaacaggtactttacaggaccttatccaacatggcagccccataaacaatgaatgtcacccttccttggaaagaaaggatgataatatggggtgtgcagtgattaacccggaaccaattactctcacctttgaaaaaaatgcacatgtaccaatacagacagaaggtgtaaatactgctgatgaacgtacaacctttaagaaggagttgattaagcaagtatcacctgctgcaagccttagacatcctgtatccacctcggaaaatgcacgaacacaaggcctgagggacattccctctctagtagttgcaggacagaagggcactaagtacctttgtgcctcgtcagtaggtggagagacacttgataaagcagtgtgttcattacagaaggagacgccccttccagtctctctaccatctgataaaacaatggtcatggaggcactatcattagctaaaagttctagtcatctatcacccagtgaagaagtgagatgcactcaggatttcctttcacagactcagagtctcctcggcctatcttcagaagggcttctagaactgacacaggttgaagtggactcatcatcagcctctaccaccttgggaaggcagtgttcacttaactgcatttcgtcaggatgccacacatcaggtgactctttagaactaaggaagaatcacaagaatggtccaaacactgaaaatatgaatttggaagcgtttgattcagtatttatcaaacaaacaagcctgtctgtgagtagagaggtcagcctagagttatcagaggaagattctgacattgacttagctctaacaatatcaccacctacaagtcccagagaagaaatgccagctggtgaaatagagcaatttgaggaggccccattctcaaatttagaacttcaggatgtagctgaggaaataggtgaaccggaagaggtggctctcacagaaagcagagaagtgagttctgctgacaatgtgtcagtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagtgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaatagtggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataa

SEQ ID NO: 132462 - DNA, 738 bp, Homo sapiens
  Payload ID: 5872
  Gene Symbol: FAM208B
  Gene Name: family with sequence similarity 208, member B
  ENST ID: ENST00000380270
  CDS Start-End: 1-738
attgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcaaagaagagagtttttccattgagtccagcgtcaaatctgagagtgcagcctaagaggaaggccagcatgccccacatggtgcagagtaaaaaggtgaacttgtgccgcccctttcccaaaagaactgcttccagagcagacaacagctcggactctccaacaactcttaagttagttaaaggacagtttcctcagaaaagaaaaagagtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttc

SEQ ID NO: 132463 - DNA, 522 bp, Homo sapiens
  Payload ID: 5872
  Gene Symbol: FAM208B
  Gene Name: family with sequence similarity 208, member B
  ENST ID: ENST00000496681
  CDS Start-End: 497-522
cggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgaaaagcaggcaaaattggtatgtcagtgtggactccgtgttggcagcagtgctgttaccactctgggtgatccagccaaagtattacttttacgaactttcaggcaacaccgttattgaacgacccagacagatctgtccttatgtaattgtagcttttcgatacagggaatctaaaactatggcaccaccagctcataaaagcat

SEQ ID NO: 132464 - DNA, 911 bp, Homo sapiens
  Payload ID: 5873
  Gene Symbol: FAM209A
  Gene Name: family with sequence similarity 209, member A
  Uniprot ID: Q5JX71
  ENST ID: ENST00000371328
  CDS Start-End: 324-839
aaatgaaaaacaaaaacatgatggcctctcccagcaaagctccagggttggaaagagtcccctggcagggaattggcaccccgtcgtgcccatcctctctctctgactgcctgctggaaatgcccccatctccctttgagtcctcctcccgggcaacccctgtgacctgtaacctctgtcctgaaatcatcacaatggccagagtggcctcagctcagggcctctgtgacatcaccaagggcctggcaccaggtgcccagtctcccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgcaatacggagagcactttcggattcggcagaatctaccagagcacacccaaggctggcttgggagcaaatggctctggcttctttttgttgttgtgccgtttgtgatactgcagtgtcaaagagacagtgagaagaataaggagcagagtcctcctggccttcgaggcggccaacttcactctccattaaagaaaaaaagaaatgcttcccccaacaaagactgtgcattcaataccttaatggaactcgaggtggagcttatgaaatttgtgtccaaagtgcggaatcttaaacgtgccatggcaacaggtagtggcagtaacctcaggcttcgaaagtcagagatgcctgcagatccataccatgtcacgatctgtgaaatatggggagaagaaagctctagctgaatggatttgtgtgtcaggagagaaaaaagttgagtgttgacaaactgtatgcaaactaataaaactattctg

SEQ ID NO: 132465 - DNA, 694 bp, Homo sapiens
  Payload ID: 5874
  Gene Symbol: FAM209B
  Gene Name: family with sequence similarity 209, member B
  Uniprot ID: Q5JX69
  ENST ID: ENST00000371325
  CDS Start-End: 97-612
gacatcaccaagggcctggcaccaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgccgtgtggagagcactttcggattcggcagaacctaccagagcacacccaaggctggcttgggagcaaatggctctggcttttgtttgctgttgtgccgtttgtgatactgcagtgtcaaagagacagtgagaagaataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatctgtaaaatatggggagaagaaagctctagctgaatggatttgtgtgtcaggagagaaaaaagttgagtgttgacaaactgtatgcaaactaataaaactattctgaagaaaagaa

SEQ ID NO: 132466 - DNA, 4272 bp, Homo sapiens
  Payload ID: 5875
  Gene Symbol: FAM21A
  Gene Name: family with sequence similarity 21, member A
  Uniprot ID: Q641Q2
  ENST ID: ENST00000282633
  CDS Start-End: 46-4071
ggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtg

SEQ ID NO: 132467 - DNA, 4519 bp, Homo sapiens
  Payload ID: 5875
  Gene Symbol: FAM21A
  Gene Name: family with sequence similarity 21, member A
  ENST ID: ENST00000314664
  CDS Start-End: 119-3958
atcaggtcacgtgaggccggtcacgccccgggcagcttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaacc

SEQ ID NO: 132468 - DNA, 4642 bp, Homo sapiens
  Payload ID: 5875
  Gene Symbol: FAM21A
  Gene Name: family with sequence similarity 21, member A
  Uniprot ID: Q641Q2
  ENST ID: ENST00000351071
  CDS Start-End: 119-4081
atcaggtcacgtgaggccggtcacgccccgggcagcttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaacc

SEQ ID NO: 132469 - DNA, 4323 bp, Homo sapiens
  Payload ID: 5875
  Gene Symbol: FAM21A
  Gene Name: family with sequence similarity 21, member A
  ENST ID: ENST00000399339
  CDS Start-End: 1-3762
atgcccaggctttctggcaagtcagtgcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaacc

SEQ ID NO: 132470 - DNA, 782 bp, Homo sapiens
  Payload ID: 5875
  Gene Symbol: FAM21A
  Gene Name: family with sequence similarity 21, member A
  ENST ID: ENST00000454806
  CDS Start-End: 1-471
tccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttattcagacttgtctgcattaaggaggaaacagcaaccagggctaccgctttgtcttcactgcactccccccaagtcatctcccctctcctcgctccacacgccagagtttcatgaatctatactttaatagttagtgttttttgatgccatgccagatttaactctgaagtggagttaaggtaggatgaagaatcttcttcccactaaagaatttatttctccctctggatttccttggaatagaattaa

SEQ ID NO: 132471 - DNA, 3287 bp, Homo sapiens
  Payload ID: 5875
  Gene Symbol: FAM21A
  Gene Name: family with sequence similarity 21, member A
  ENST ID: ENST00000434114
  CDS Start-End: 83-403
ttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaaaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagtttggcaaactgtggcccccccactgtcatattttgttaataaaattttattggaacac

SEQ ID NO: 132472 - DNA, 4417 bp, Homo sapiens
  Payload ID: 5875
  Gene Symbol: FAM21A
  Gene Name: family with sequence similarity 21, member A
  ENST ID: ENST00000611324
  CDS Start-End: 119-3856
atcaggtcacgtgaggccggtcacgccccgggcagcttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaacc

SEQ ID NO: 132473 - DNA, 4669 bp, Homo sapiens
  Payload ID: 5876
  Gene Symbol: FAM21C
  Gene Name: family with sequence similarity 21, member C
  ENST ID: ENST00000336378
  CDS Start-End: 83-4108
ttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 132474 - DNA, 4471 bp, Homo sapiens
  Payload ID: 5876
  Gene Symbol: FAM21C
  Gene Name: family with sequence similarity 21, member C
  ENST ID: ENST00000359860
  CDS Start-End: 122-3910
atcaggtcacgtgaggccggtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggccgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 132475 - DNA, 4623 bp, Homo sapiens
  Payload ID: 5876
  Gene Symbol: FAM21C
  Gene Name: family with sequence similarity 21, member C
  Uniprot ID: Q9Y4E1
  ENST ID: ENST00000374362
  CDS Start-End: 100-4062
gtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 132476 - DNA, 868 bp, Homo sapiens
  Payload ID: 5876
  Gene Symbol: FAM21C
  Gene Name: family with sequence similarity 21, member C
  ENST ID: ENST00000420848
  CDS Start-End: 31-868
cctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggccgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacg

SEQ ID NO: 132477 - DNA, 4519 bp, Homo sapiens
  Payload ID: 5876
  Gene Symbol: FAM21C
  Gene Name: family with sequence similarity 21, member C
  Uniprot ID: Q9Y4E1
  ENST ID: ENST00000540872
  CDS Start-End: 119-3958
atcaggtcacgtgaggccggtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 132478 - DNA, 4417 bp, Homo sapiens
  Payload ID: 5876
  Gene Symbol: FAM21C
  Gene Name: family with sequence similarity 21, member C
  Uniprot ID: Q9Y4E1
  ENST ID: ENST00000537517
  CDS Start-End: 119-3856
atcaggtcacgtgaggccggtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 132479 - DNA, 4616 bp, Homo sapiens
  Payload ID: 5876
  Gene Symbol: FAM21C
  Gene Name: family with sequence similarity 21, member C
  ENST ID: ENST00000623400
  CDS Start-End: 55-4080
gcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgtt

SEQ ID NO: 132480 - DNA, 4340 bp, Homo sapiens
  Payload ID: 5877
  Gene Symbol: FAM210A
  Gene Name: family with sequence similarity 210, member A
  Uniprot ID: Q96ND0
  ENST ID: ENST00000322247
  CDS Start-End: 389-1207
gcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagagtctcactctgtctcccaggctgcaacatccacctcccaggttcaagtgattcttgtgcctcagcctctccagtagctgggattacaggtgtgtgccagcatgcctggccaattgttggattgtatgaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacatactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaaccttaaattcattgttaaaatcaaatatttgtcagcagtaactcaagctcatggttctcaagcagaaaaaggtttgggagactaaaaatggagtcaggttttcatggagactgctaactccttggggtagacatgggccttgcctcagcaaaccagtgcaatttcccaatgtcttagtttcagaattcatgctgatttcattatggagtaaagttttaaattgtggctgctgctttttgtcttacattgaagggaaatatccttgtttgagcattctacttgattttttttttttttttttttttttttgagacggagcctccctctctctctcccagactggagtgcaatggtacaatctcggctcactgcatcctctgcctcccaggttcaagtgatcctcccgcctcagctttccaagtagctgggagtataagcgtgtgccaccacactcagctaatttttgtatttttagtggaggtggagtttcaccatgttagccaggctagtctccaactcctgacctcagcctcccgagtagctgggactacaggcgcccaccaccacgcccagctaatttttttgtatttttagtagagatggggtttcaccatcttaacaaagctatcattaaatcatttgcttgtaatgaaattcagccgttgtcagctgtgagcgttgcggggctggtggggtgtgtttgagtatgtaagtgtctatttcctgtgctctaacagtgactatttcagttctaacccttcaattgctaattggatgagggaatggcctcttagattgtccttgttttgacttatctgctaaggcgagagaatgtctgggtttgccacacagtcccgcagggacccctgctctttgccaggatttttatatcaagtacttagtttggccaaatttagagtatagtttaaaggggaaaaaaagtttgtatttgatgagtctaattactatattagaatgctttttaaatgaatatgctgtgattggaatctcttcttgggggccggggagagtgctgagagatgcagctgtgtctctgctctctgcagtcttgggcaggcagcaccgctgtctcctgatacagagggttgaatgcactgcttcacattgatgccacattttcaaatctaaacatgattaacatgttttttaagtatttatcaaataattcacatttttgcaggtttaagtgctgttttttaagatattaaacatgttccttgtttcttttttctttttaaccactggagactatgtgaaaatcttgtgttatatggaatttttctaaaacaatttccttttacttttcatgttgcatattttccagtggggataaattggaggttcttattactaataatcctgaaactaaaatttgcttttcctgcatagacatcttttgttagtccatttgagttttgttgccatccagtttcatgatcatgttgtgttagtctaatagacaatgagttactgcttgaatgatatgaaattctctagtaaaaaatgctctgaagatgtgagaagctctgttgtattacttggcaccaggaatgttacaaaaatgttgttgctagcatattgctaacctagtccttaagtttcagggattcctgtaatatgttgagtttggagtattaatagcaggctaacagaatacagtaccaatatgccaagttaaataattgagaatatatacagtatagtttgctatgtataatagacctcatttcatttacagtacacctcacacttgggattaattcacctataacctctgtgaactgcgagtgctcggcagaagcagccctgtgtcttacatgtctacatttatatttatatttatatttatttttttgagacagagtctcactctgtcacccaggctagagtgcagtggcatgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactgagattacctacctcccagtagtgaaaataataaatttatcccttgaaatataa

SEQ ID NO: 132481 - DNA, 4240 bp, Homo sapiens
  Payload ID: 5877
  Gene Symbol: FAM210A
  Gene Name: family with sequence similarity 210, member A
  Uniprot ID: Q96ND0
  ENST ID: ENST00000402563
  CDS Start-End: 293-1111
aactacgagtcccgacgtgccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacatactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaaccttaaattcattgttaaaatcaaatatttgtcagcagtaactcaagctcatggttctcaagcagaaaaaggtttgggagactaaaaatggagtcaggttttcatggagactgctaactccttggggtagacatgggccttgcctcagcaaaccagtgcaatttcccaatgtcttagtttcagaattcatgctgatttcattatggagtaaagttttaaattgtggctgctgctttttgtcttacattgaagggaaatatccttgtttgagcattctacttgattttttttttttttttttttttttttgagacggagcctccctctctctctcccagactggagtgcaatggtacaatctcggctcactgcatcctctgcctcccaggttcaagtgatcctcccgcctcagctttccaagtagctgggagtataagcgtgtgccaccacactcagctaatttttgtatttttagtggaggtggagtttcaccatgttagccaggctagtctccaactcctgacctcagcctcccgagtagctgggactacaggcgcccaccaccacgcccagctaatttttttgtatttttagtagagatggggtttcaccatcttaacaaagctatcattaaatcatttgcttgtaatgaaattcagccgttgtcagctgtgagcgttgcggggctggtggggtgtgtttgagtatgtaagtgtctatttcctgtgctctaacagtgactatttcagttctaacccttcaattgctaattggatgagggaatggcctcttagattgtccttgttttgacttatctgctaaggcgagagaatgtctgggtttgccacacagtcccgcagggacccctgctctttgccaggatttttatatcaagtacttagtttggccaaatttagagtatagtttaaaggggaaaaaaagtttgtatttgatgagtctaattactatattagaatgctttttaaatgaatatgctgtgattggaatctcttcttgggggccggggagagtgctgagagatgcagctgtgtctctgctctctgcagtcttgggcaggcagcaccgctgtctcctgatacagagggttgaatgcactgcttcacattgatgccacattttcaaatctaaacatgattaacatgttttttaagtatttatcaaataattcacatttttgcaggtttaagtgctgttttttaagatattaaacatgttccttgtttcttttttctttttaaccactggagactatgtgaaaatcttgtgttatatggaatttttctaaaacaatttccttttacttttcatgttgcatattttccagtggggataaattggaggttcttattactaataatcctgaaactaaaatttgcttttcctgcatagacatcttttgttagtccatttgagttttgttgccatccagtttcatgatcatgttgtgttagtctaatagacaatgagttactgcttgaatgatatgaaattctctagtaaaaaatgctctgaagatgtgagaagctctgttgtattacttggcaccaggaatgttacaaaaatgttgttgctagcatattgctaacctagtccttaagtttcagggattcctgtaatatgttgagtttggagtattaatagcaggctaacagaatacagtaccaatatgccaagttaaataattgagaatatatacagtatagtttgctatgtataatagacctcatttcatttacagtacacctcacacttgggattaattcacctataacctctgtgaactgcgagtgctcggcagaagcagccctgtgtcttacatgtctacatttatatttatatttatatttatttttttgagacagagtctcactctgtcacccaggctagagtgcagtggcatgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactgagattacctacctcccagtagtgaaaataataaatttatcccttgaaat

SEQ ID NO: 132482 - DNA, 1091 bp, Homo sapiens
  Payload ID: 5877
  Gene Symbol: FAM210A
  Gene Name: family with sequence similarity 210, member A
  ENST ID: ENST00000592976
  CDS Start-End: 287-1091
gagtcccgacgtgccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaaga

SEQ ID NO: 132483 - DNA, 659 bp, Homo sapiens
  Payload ID: 5877
  Gene Symbol: FAM210A
  Gene Name: family with sequence similarity 210, member A
  ENST ID: ENST00000589346
  CDS Start-End: 1-204
gggttacctgacagtgtggtaagcatcctgaaaaactcccagagtggaaatgccctcacagcatatgccttgtttaaggctggagtacaatggcgcgatctcggctcaccgcaacctctgcctcccgggttcaagcaattctcctgctttagcctcccaagtagctgggattacagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtctta

SEQ ID NO: 132484 - DNA, 1038 bp, Homo sapiens
  Payload ID: 5877
  Gene Symbol: FAM210A
  Gene Name: family with sequence similarity 210, member A
  ENST ID: ENST00000591269
  CDS Start-End: 504-1038
acttccggaggtgcgagagtcacgtggagacggtcaggcgagagtgccgcgacgcacgtcctccgcgccggaactacgagtcccgacgtgccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagaaagaatttgactgatgggcgtaaggaagaaaaagagaccgaggcaagtttcagagaagtagtggaagatttttcaaaaaagctgtagaacaagaaagaaagtatgcttgggaaagacccaagcgggcatgtgaaggaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcc

SEQ ID NO: 132485 - DNA, 3046 bp, Homo sapiens
  Payload ID: 5878
  Gene Symbol: FAM210B
  Gene Name: family with sequence similarity 210, member B
  Uniprot ID: Q96KR6
  ENST ID: ENST00000371384
  CDS Start-End: 92-670
agggccctcgccgggtcagctccgcccaccctccccggcctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgcaaaaaaaaaaaaagaaaaaaaagaaaaactgatggtgaaacctacaggtttaagggcttaaatctcaaactttgttaggagtaacaggagcgtgctgagcgggcaagcaataaaacaaatcataccaaaaagccacattgctctctcctaagccccaaccccactccactcctgtggccaggggtccaaacagaaaataaccggagaagacaaggaggtcaaaggatcagggaactaagcattatgtgaattcaccagcaagatgtacagaacgcctgtgtttacattgtttttatggaactagcagaataaaacatctattttaaaaatgaaa

SEQ ID NO: 132486 - DNA, 614 bp, Homo sapiens
  Payload ID: 5878
  Gene Symbol: FAM210B
  Gene Name: family with sequence similarity 210, member B
  ENST ID: ENST00000437418
  CDS Start-End: 1-158
cgcccctggccctggccctgctcccgcccaggctagacgcccggctgctccgcacggcgcgcggggactgccgcggccaccagtccgacaggtggcacacaggtcttggggatcctctccagagtggcaccttctgcacacaccgtgccgcctcctgatgattcttcagggcccagcccagctgttccttcctccgggaagccctctctaacgacctgtgaggtctcggatgcctccactgggcctgcttccaccccatggctgtgggtcttctctgcactcatctggaatggcctcttgtcctgcctgtcagccacattgaccttgtccccagctcaggccctggcactggagcggtgtgtgtgtatacagtggcaaagagttggcctcagactccctggattcctctctctactcacttgttgttgactttgatcaaattcccttctctctatctcaggcccctcatctgtaaaatgggacgttaataattcagacttcatagaatatgaatgtaaaatgagatatgttcatacctggcatctggtgtgtcctaaattaaggttagaaatgactataattgcagtaaatatatacagtcacaaggccccagg

SEQ ID NO: 132487 - DNA, 1040 bp, Homo sapiens
  Payload ID: 5879
  Gene Symbol: FAM212A
  Gene Name: family with sequence similarity 212, member A
  Uniprot ID: Q96EL1
  ENST ID: ENST00000333323
  CDS Start-End: 134-997
gggagctacggagagcgaggagtcgcgcaggcaggcggaggctgagggcgccgctggccggccctcccagccctctccgcgcggctccgccggggttccaagaggagctagtaggttcggtgggggccctggcatggacatgcacagcgctcggcttgacagcttccttagccagctccgctgggaactgttgtgtggtcgggacacaggctcaccctcaatgcctggtcccctgcagccaacctcccaaactggcccagatgtgcagcccagccaccagcttagggcctcgggtgccttggaagaggactcagtctgctgtgtggaggaggaggaagaggaggaggaggaagcagtggtgacagaagacagggatgcagccttgggaggccccagggagcatgccctggactgggactctggcttctcggaggtgtcaggcagcacatggcgagaggaagaactgcctgtatcccagcgcccagcaccctcagcacagccccttcgtaggcagtgcctctcagtcagtggcctccccatgcccagcagggcccctgtagccagtgtaccacctgtccaccatccacggcccaagtccaccccagacgcctgcctggagcactggcagggactggaagcagaggactggacagcagccctactgaacaggggtcgcagtcgccagcccctggtactaggggacaattgctttgctgacttggtgcacaactggatggagctgcctgagacagggagtgaagggggtgacggaggtgggcaccgtgcccgtgctcggccccctcagttcctgcttggcctctctgagcagcttcggcgccggctggccagggctcggcggacagctatggcaggaaagcggctgtcatgcccacctcgcccagaacctgaactgcctgcggatgtctcacgctttgcagctctcatgagctgtcgtagccgccagcccatcatctgcaatgatgtcagctacctctgaccctgccctccagcctgggacaataaaagccttttttctagac

SEQ ID NO: 132488 - DNA, 5980 bp, Homo sapiens
  Payload ID: 5880
  Gene Symbol: FAM212B
  Gene Name: family with sequence similarity 212, member B
  Uniprot ID: Q9NTI7
  ENST ID: ENST00000357260
  CDS Start-End: 183-1076
gaccgcgcgcggctagccgctggggaagcgactctgagtcccgggctcggagcgcaggctcagctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaaccttctgtcagcttctttggcaagacattgctccaggcacagggactgaaccccaggcctcctgggactggagcagcagtgaggcaaaacccgacctgctagccctttctgccttggaggtttcagtccatacctggactctgagaaaatgagctgaataaggagtacagtgtgtaaggagcagccagggaagccctagacactccccgcgtctcccccatgcacaggggaaggatgttgacatagcactgggctgtttgaatgccttttcatctccatggtctcatttgaaagtgagcgaggcaggcaggcatgatcccattttccagataaggaaacaagcctagatatgctacatgtccaggaacaactgcagccaggaggcagaacagcctaggtctaactgcagagtagaagctggaccctggagttaccaacactcctccccaacagttcttagcaccccgcaggctgggcgctgtggctcacgcctgtaatcccagcactttgggagggcaaggcaggcggattacctggggtcaggagttcatgaccagcctggccaacatggtgaaaccccgtctctactaaaaaaatacgtaaaaattagccaggcgtggtggcacacgcctgtaaacccagctacttgggaggctgaggcaggagaattgcttgagcccgggagagggaggttgcagtgaggcgagatcatgccactgcactccagcctggctgacagagcaagactcccctgtctcaaaaaaaataaaaaaaaacagttcgtagggccccataccccacaacccctgtctcctgcacttaactcccacctgggtcagagaacagccaattcaccagtgaggtagaagtgaacccagaagaaatagccacttgattttaaaattcccagctccattccgtggccttctccccactagacacagcagtcccaggcctcctgttccctcctcacctagaggcagccgggacggagggggaagggccaggcagcagctcagctccggcttctctaaagccactctgggcacgtggcccaggagggccacctagtgatccaggcccccccccaggactgccctgggaagccactgtccctcccactccagtagggaacactcactggctgggaaaagacaatgtggatcttcttttgggctgaccaagccaggagggcacaccctcccactgcccctctctgcctcccactgattgtccctcagcctgatggggtgtgacagctgcaattagaggcaggattccttcccaccctcaaagcattaatagccagttggagaggcaaaatagtaagaaaaggctcttctgcttgcttcctggatccctggggagagtggagagaggggcagagctcaagatgggattatgggggcgcagccgcggtggttagggtcactctcaaatcctacccagtcaaatggtaagatgtttcatttttggtgggggagctgcaggagggaggaaggcgctcatgctttttgggttttgttgagcactcactgtctgtcaggtaatgtgcacatctctcaaacttagaaggaccctagaaggcattgttctccagacacatctatggaggttattagggggcgtgtaaactgccccgattaggctgctagcaaaggaaaggacagagatttgaacagagggttgggttatctggctccaaaacccctgtccttttcttgctatttctctacctggagtttgccaactgagcaagcccactctggtggagccagccactgcaaatcctttgtgtcttcccagagaataccaacatttcagttttgagtgagggaacgttggctctgactgcctttggaggtggagatggtggaggtggtggtggtggtggtggtagtggtggtgtgtgtgtgtgtgtgtgtgtgtgtgtgtgtgtgcctgcgcgtgctaagaaactgcatgttaagattccacctactgaatcatgagcggaggaagtcgtgggacactggctggtggagaagccatctagcatattattcaagatgacaccagctccaagtctggaatgagtctgtgggaaaccaaggtacttcttggacattcacctataactcacgtgtttcgtggactggtcacagtggttcggataaattgaacagaactttatgaacacctcccagcaccaggtgttgttatagaaactaagaacagagcaatgagaaggacccaactcctgctctcaaatggatgcagtggaaaataagcagactttgaaccattggttagtcagaagagacttgggagactgaaaacttgtttcaacttgggccagaacaaaaaattaggaagcaacacttgctgccaacatgatttacaagtgccagcaccttcacctctgttacttccttctcactacacactgaaagcagttgctcttgttttacatggacaggctcagagaagttaagcaacttgtccaaggtcacacagtagtggaattgagattgaatcagttccaactgacttgcaatcttgtgcttttcagacgatcccactaattgtccatatctgttccaaagccaaatcaagaggaacaagagcaaaatctgtcctctcatattattcatggtcctgcgtggatcataaatggcatgctgactgtctgatggagacttacttttcccttccccctggacacctgccatggcaatgacagaggctgtattttactgaagtggagggaagaggtgaatgcaaatgcctagggcctaagtatacaggaaggtgtagggagaggtaagcagtgtgtatgtggaggagatagcagacgtaagcagagagaaatcagagagcttagttcttcctctggggcgcactttgtggttaattaggacatgcaaatgagctagaagctcatttaatatcctccctgacatgtagccccaccccaccctgccccacttccctggcaggtacaagggccacctgattggcccaggtatctgtggaaggttccacctgcttctttgtggcccagggaacagaaaagagtccctgctgggcatgctagtggggccggcctggtctccctcctccctttctcttcccaacctttcagacttgggacctctcttttccctctccctcagacacttcccttgtgccccgcccctcagggtgatctctgaacccaaacttgccccaaagaaggttgctctgtcctctccacatccccatctcctccctagggccttgttggggagaggctcctccatctttcccaagtcacaccatcgtttcctacgtggtctggacaagagcaagagcacaccttgtccccaccttctccagagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctgagcgttggtctcttcttctgtcgaaacatttatattgatttaatatctcacaggattgtagcaagggtcagagaagacaataggtgacatgtttttgtacactgtatactagccacccagatgggctgttatttgctaaatggcaaatttacactgttccccaaaggatgacatgcactggggaggcggggggtgtggaggtggagaaaggctgagcttggagaaaaggtgcttgaggaccccactgcctaaggacctgctctaggaaacattcccactccctacaccctagctgcccctcacagtcaacccttaaggacctcaaattcttggcaaggggtaaagagttgaaagtgccaagtcctagtggttttgagaagcctctggtctgctctttctgctctgtaaagtcttagttgccagagtcccctatagcccccacatcgctcccttcctcctgccctccggccaccctggaaactaatggcctaaaggtgctgtggctgtcctcctaaaatccattccctcctgatggggtggaggaatctgtgaagcccaccttcaggagaggtctcggggctcgggctggtgctgccagagaaagggtgactgaaccagaaaggcctaggggaaagcagctcaaactgcagccatccccttagtacgattactaggatgtcccttgccttccttttgcctcctccacccaacccctaaaataaacagtatgatgaaacctc

SEQ ID NO: 132489 - DNA, 1423 bp, Homo sapiens
  Payload ID: 5880
  Gene Symbol: FAM212B
  Gene Name: family with sequence similarity 212, member B
  Uniprot ID: Q9NTI7
  ENST ID: ENST00000444059
  CDS Start-End: 113-961
aacacgcccggcctggaagtggaagaaagggacgggagtcggaggctgagagactgcccagacacacaaaaaatgtggcctgaggaaagccccaagagggaggagaggaaagatgaggcaactgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaa

SEQ ID NO: 132490 - DNA, 1217 bp, Homo sapiens
  Payload ID: 5880
  Gene Symbol: FAM212B
  Gene Name: family with sequence similarity 212, member B
  ENST ID: ENST00000534365
  CDS Start-End: 122-466
agctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttgagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctgagcgttggtctcttcttctgtcgaaacatttatattgatttaatatctcacaggattgtagcaagggtcagagaagacaataggtgacatgtttttgtacactgtatactagccacccagatgggctgttatttgctaaatggcaaatttacactgttccccaaaggatgacatgcactggggaggcggggggtgtggaggtggagaaaggctgagcttggagaaaaggtgcttgaggaccccactgcctaaggacctgctctaggaaacattcccactccctacaccctagctgcccctcacagtcaacccttaaggacctcaaattcttggcaaggggtaaagagttgaaagtgccaagtcctagtggttttgagaagcctctggtctgctctttctgctctgtaaagtcttagttgccagagtcccctatagcccccacatcgctccctt

SEQ ID NO: 132491 - DNA, 556 bp, Homo sapiens
  Payload ID: 5880
  Gene Symbol: FAM212B
  Gene Name: family with sequence similarity 212, member B
  ENST ID: ENST00000527621
  CDS Start-End: 12-556
caaatgggcgcatgacgatggagagcagggaaatggactgctatctccgtcgcctcaaacaggagctggccccatgctttctctctcccctgcagatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgcc

SEQ ID NO: 132492 - DNA, 2058 bp, Homo sapiens
  Payload ID: 5881
  Gene Symbol: FAM213A
  Gene Name: family with sequence similarity 213, member A
  Uniprot ID: Q9BRX8
  ENST ID: ENST00000372181
  CDS Start-End: 471-1160
agtatcctctgatcacagaagagaaagctgcccctacccagggacatgatcctgagccacctggattgtgagggagaatcaggcattgatgaggaggggaatgaggaagtagtctgcctacaggggacatagctcggcacagctccacagagctaggggctgcaacttggggcatgagaagagagagcagcaagagaaccatttgagaaggctgtcctttctctgtcatcactcctgatgccctggtgagctccacggtgcaggaacctccatgtgtgtgctgcatccccaagttctggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 132493 - DNA, 1723 bp, Homo sapiens
  Payload ID: 5881
  Gene Symbol: FAM213A
  Gene Name: family with sequence similarity 213, member A
  Uniprot ID: Q9BRX8
  ENST ID: ENST00000372185
  CDS Start-End: 169-825
tggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 132494 - DNA, 1647 bp, Homo sapiens
  Payload ID: 5881
  Gene Symbol: FAM213A
  Gene Name: family with sequence similarity 213, member A
  Uniprot ID: Q9BRX8
  ENST ID: ENST00000372187
  CDS Start-End: 61-750
gctcacccctggatatacttctttgtcaagagaagcagaggtgtggacgctgtgtatgaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatc

SEQ ID NO: 132495 - DNA, 829 bp, Homo sapiens
  Payload ID: 5881
  Gene Symbol: FAM213A
  Gene Name: family with sequence similarity 213, member A
  Uniprot ID: Q9BRX8
  ENST ID: ENST00000372188
  CDS Start-End: 131-820
tgcccagactggtcttgaactcctgggctcaagcgatcctcccaaagccctgagattacaggcgtgagccagcgcgccggacacaacctcctactttcatgaaagagtgggcacttccaacaggaggaaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaa

SEQ ID NO: 132496 - DNA, 2213 bp, Homo sapiens
  Payload ID: 5881
  Gene Symbol: FAM213A
  Gene Name: family with sequence similarity 213, member A
  Uniprot ID: Q9BRX8
  ENST ID: ENST00000615554
  CDS Start-End: 627-1316
gggtcacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagtatcctctgatcacagaagagaaagctgcccctacccagggacatgatcctgagccacctggattgtgagggagaatcaggcattgatgaggaggggaatgaggaagtagtctgcctacaggggacatagctcggcacagctccacagagctaggggctgcaacttggggcatgagaagagagagcagcaagagaaccatttgagaaggctgtcctttctctgtcatcactcctgatgccctggtgagctccacggtgcaggaacctccatgtgtgtgctgcatccccaagttctggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatc

SEQ ID NO: 132497 - DNA, 5859 bp, Homo sapiens
  Payload ID: 5881
  Gene Symbol: FAM213A
  Gene Name: family with sequence similarity 213, member A
  Uniprot ID: Q9BRX8
  ENST ID: ENST00000606162
  CDS Start-End: 154-843
atggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccaagttactgggcttacaggtggatgccaccgtacccaacagattttatttttgtagggatgggggtctccctgtattgcccaggctggtctcaaactcctggcctcccaaagtgtttagattacaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctagagtgcagtaatgcaatcatggctcactgctgccttaacttctgggctcaagtgatatcctcccacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 132498 - DNA, 2765 bp, Homo sapiens
  Payload ID: 5882
  Gene Symbol: FAM213B
  Gene Name: family with sequence similarity 213, member B
  ENST ID: ENST00000378424
  CDS Start-End: 17-712
gcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggctctggacccaggcttctccggagtttggccaagcgacctggtgtcttcgcaggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcc

SEQ ID NO: 132499 - DNA, 2665 bp, Homo sapiens
  Payload ID: 5882
  Gene Symbol: FAM213B
  Gene Name: family with sequence similarity 213, member B
  ENST ID: ENST00000378425
  CDS Start-End: 47-625
aaaggcgggaccggggcatctcggggcggggcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcc

SEQ ID NO: 132500 - DNA, 2689 bp, Homo sapiens
  Payload ID: 5882
  Gene Symbol: FAM213B
  Gene Name: family with sequence similarity 213, member B
  ENST ID: ENST00000378427
  CDS Start-End: 1-640
gagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttg

SEQ ID NO: 132501 - DNA, 2749 bp, Homo sapiens
  Payload ID: 5882
  Gene Symbol: FAM213B
  Gene Name: family with sequence similarity 213, member B
  Uniprot ID: Q8TBF2
  ENST ID: ENST00000419916
  CDS Start-End: 22-708
gcggggcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcca

SEQ ID NO: 132502 - DNA, 2827 bp, Homo sapiens
  Payload ID: 5882
  Gene Symbol: FAM213B
  Gene Name: family with sequence similarity 213, member B
  ENST ID: ENST00000444521
  CDS Start-End: 47-787
aaaggcgggaccggggcatctcggggcggggcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggctctggacccaggcttctccggagtttggccaagcgacctggtgtcttcgcaggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcc

SEQ ID NO: 132503 - DNA, 1096 bp, Homo sapiens
  Payload ID: 5882
  Gene Symbol: FAM213B
  Gene Name: family with sequence similarity 213, member B
  Uniprot ID: Q8TBF2
  ENST ID: ENST00000537325
  CDS Start-End: 1-576
atgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagact

SEQ ID NO: 132504 - DNA, 589 bp, Homo sapiens
  Payload ID: 5882
  Gene Symbol: FAM213B
  Gene Name: family with sequence similarity 213, member B
  ENST ID: ENST00000465233
  CDS Start-End: 1-589
gagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggctgtacccactcctgacaggccaaggctgttggcatccaggggaacttgtctggggacctgctgcagagcggagggctgctggtggtcagcaaaggtggtgataaagtgctcctgcatttcgtccagaagtccccaggcgactacgtcccc

SEQ ID NO: 132505 - DNA, 464 bp, Homo sapiens
  Payload ID: 5882
  Gene Symbol: FAM213B
  Gene Name: family with sequence similarity 213, member B
  ENST ID: ENST00000498083
  CDS Start-End: 1-464
gcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggtggtgataaagtgctcctgcatttcgtccagaagtccccaggcgactacgtccccaaggagcacatcctg

SEQ ID NO: 132506 - DNA, 2827 bp, Homo sapiens; identical to SEQ ID NO: 132502
  Payload ID: 5882
  Gene Symbol: FAM213B
  Gene Name: family with sequence similarity 213, member B
  ENST ID: ENST00000616280
  CDS Start-End: 47-787

SEQ ID NO: 132507 - DNA, 2665 bp, Homo sapiens; identical to SEQ ID NO: 132499
  Payload ID: 5882
  Gene Symbol: FAM213B
  Gene Name: family with sequence similarity 213, member B
  ENST ID: ENST00000617400
  CDS Start-End: 47-625

SEQ ID NO: 132508 - DNA, 2689 bp, Homo sapiens; identical to SEQ ID NO: 132500
  Payload ID: 5882
  Gene Symbol: FAM213B
  Gene Name: family with sequence similarity 213, member B
  ENST ID: ENST00000628389
  CDS Start-End: 1-640

SEQ ID NO: 132509 - DNA, 2765 bp, Homo sapiens; identical to SEQ ID NO: 132498
  Payload ID: 5882
  Gene Symbol: FAM213B
  Gene Name: family with sequence similarity 213, member B
  ENST ID: ENST00000626354
  CDS Start-End: 17-712

SEQ ID NO: 132510 - DNA, 2749 bp, Homo sapiens; identical to SEQ ID NO: 132501
  Payload ID: 5882
  Gene Symbol: FAM213B
  Gene Name: family with sequence similarity 213, member B
  Uniprot ID: Q8TBF2
  ENST ID: ENST00000629512
  CDS Start-End: 22-708

SEQ ID NO: 132511 - DNA, 589 bp, Homo sapiens; identical to SEQ ID NO: 132504
  Payload ID: 5882
  Gene Symbol: FAM213B
  Gene Name: family with sequence similarity 213, member B
  ENST ID: ENST00000630935
  CDS Start-End: 1-589

SEQ ID NO: 132512 - DNA, 1096 bp, Homo sapiens; identical to SEQ ID NO: 132503
  Payload ID: 5882
  Gene Symbol: FAM213B
  Gene Name: family with sequence similarity 213, member B
  Uniprot ID: Q8TBF2
  ENST ID: ENST00000627654
  CDS Start-End: 1-576

SEQ ID NO: 132513 - DNA, 464 bp, Homo sapiens; identical to SEQ ID NO: 132505
  Payload ID: 5882
  Gene Symbol: FAM213B
  Gene Name: family with sequence similarity 213, member B
  ENST ID: ENST00000630439
  CDS Start-End: 1-464

SEQ ID NO: 132514 - DNA, 4217 bp, Homo sapiens
  Payload ID: 5883
  Gene Symbol: FAM214A
  Gene Name: family with sequence similarity 214, member A
  Uniprot ID: Q32MH5
  ENST ID: ENST00000261844
  CDS Start-End: 154-3384
taaacttggccgcggttgccgcaggaaggctagccagagggtaattacacagcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaa

SEQ ID NO: 132515 - DNA, 3048 bp, Homo sapiens
  Payload ID: 5883
  Gene Symbol: FAM214A
  Gene Name: family with sequence similarity 214, member A
  ENST ID: ENST00000399202
  CDS Start-End: 234-3048
caggctgtaaacacctcccccggagccggccgcggaggactggttgggagttgcattttgaaagcgaagcagaagccgtagaatcagcggcgagcctgttgaaagaacccacaggtgcatttcacagcactctgggcgaaaattggatgtgaaaatgaagccagaccgagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggt

SEQ ID NO: 132516 - DNA, 3697 bp, Homo sapiens
  Payload ID: 5883
  Gene Symbol: FAM214A
  Gene Name: family with sequence similarity 214, member A
  Uniprot ID: Q32MH5
  ENST ID: ENST00000546305
  CDS Start-End: 145-3396
gaaaaaccttacacggagggaagcgggatcagcacccaacgctgaacatttgttttaaccgctgcagacatctggatccctcagttactgatagtatagctattgatagccagaaggcaacttcctttatacaaggattccagtatggttttcagtggaaacaaagggcttcacagagaagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttcctt

SEQ ID NO: 132517 - DNA, 4590 bp, Homo sapiens
  Payload ID: 5883
  Gene Symbol: FAM214A
  Gene Name: family with sequence similarity 214, member A
  Uniprot ID: Q32MH5
  ENST ID: ENST00000534964
  CDS Start-End: 432-3323
gcacaggctgtaaacacctcccccggagccggccgcggaggactggttgggagttggtagggtcgccccgggacagcccggaagagttcgtttggggctgggggctgggcgggaggaggtgactcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtggtatgtgttttatagcctacaattgcaataatcattctctcacatacatatagaacttagccctttctcctgctactgctgctgcaacaactttgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaa

SEQ ID NO: 132518 - DNA, 393 bp, Homo sapiens
  Payload ID: 5883
  Gene Symbol: FAM214A
  Gene Name: family with sequence similarity 214, member A
  ENST ID: ENST00000570204
  CDS Start-End: 1-138
agagcctttcatcctcaaactggattgcctcttctttcaagccctgttcctcaaagaaaaacacaatcaggttgctttgatctggattcttcattactacatctgaaaagcttctcatctagaaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttg

SEQ ID NO: 132519 - DNA, 576 bp, Homo sapiens
  Payload ID: 5883
  Gene Symbol: FAM214A
  Gene Name: family with sequence similarity 214, member A
  ENST ID: ENST00000566768
  CDS Start-End: 199-576
aaacagcagagaaagaactggccgagcgagggggacggggagccggggcgccagagctagagacagcgggcgggcaaggagctggcagaggcgctggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaaga

SEQ ID NO: 132520 - DNA, 468 bp, Homo sapiens
  Payload ID: 5883
  Gene Symbol: FAM214A
  Gene Name: family with sequence similarity 214, member A
  ENST ID: ENST00000568863
  CDS Start-End: 201-468
gcagttggtgccaggaagaggcctaacttaacagtagtttacttgcaaggtccgggtattagaatagggccagattaattttatttttgtctctttcagcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatgg

SEQ ID NO: 132521 - DNA, 931 bp, Homo sapiens
  Payload ID: 5883
  Gene Symbol: FAM214A
  Gene Name: family with sequence similarity 214, member A
  ENST ID: ENST00000561543
  CDS Start-End: 647-931
aaacagcagagaaagaactggccgagcgagggggacggggagccggggcgccagagctagagacagcgggcgggcaaggagctggcagaggcgctgggcaagagggccggccggggctacgggcgggggaagcccgggggtcgcggggctcgggtgccagtcaggcagggcggaggggctgagcgcagggagcggagcgaggcggtggctgaggcgcgggtggatggccacaggggcgccggggagccgcttcgggctggtcgtctcgggtccccacggtcacctgaggcagccgcgggggccgctgcgctccatactccgctcccgctggccctgcgcctctcggagcctggggtctgaggtgggagtgtgatgtgagctgctgggcgagcggtggagagaagtgccaagaggaggcgggattgggacgggagaggagagcgagttagtcagcagaggtcggccgagggagcggaggagccggccagctcgagagcgccatgaaaacaactctccagcggggagaggggcagacgcggcgctcgcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctacta

SEQ ID NO: 132522 - DNA, 547 bp, Homo sapiens
  Payload ID: 5883
  Gene Symbol: FAM214A
  Gene Name: family with sequence similarity 214, member A
  ENST ID: ENST00000561490
  CDS Start-End: 194-547
ctactgctgctgccgctgcctgtagactttcagatcatctccctcttctgtgtcagggaatgctcctggctggtgcggacacaacccaatagcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaag

SEQ ID NO: 132523 - DNA, 581 bp, Homo sapiens
  Payload ID: 5883
  Gene Symbol: FAM214A
  Gene Name: family with sequence similarity 214, member A
  ENST ID: ENST00000562135
  CDS Start-End: 155-581
caggctgtaaacacctcccccggagccggccgcggaggactggttgggagttgcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaag

SEQ ID NO: 132524 - DNA, 667 bp, Homo sapiens
  Payload ID: 5883
  Gene Symbol: FAM214A
  Gene Name: family with sequence similarity 214, member A
  ENST ID: ENST00000568637
  CDS Start-End: 1-667
ttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatc

SEQ ID NO: 132525 - DNA, 2993 bp, Homo sapiens
  Payload ID: 5883
  Gene Symbol: FAM214A
  Gene Name: family with sequence similarity 214, member A
  ENST ID: ENST00000562351
  CDS Start-End: 233-325
cggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagaaacgaggtctcactctgttgctcagcctggtcttaaactcatgtcctcaagcaatcttcctgtatcagcctcctaaagtctggaattacaagcatgagccaccatgcctggcctccactatccctttctgtttgtggtggtctcctatattttgagtttgaatgggaagggagcatgcatgtttgatggtttgttttgtttttgtgaatgaagaatgaaaatttattcccattaagtgcgagcttcaattgaggcactcagtttatgaggtcttactgatgtttcctctcttaggtgctgtagttaaaatcttgctggtctaaaatggtgaaaactattgaggtattcaaatgataagtactttataaactgaaattgcattgaaaacggagagctcttgacagaaaggttgactctagcatttatataaggaaaaagacaactattatctccctctacacagaaagctatattcagtagttataggatttgtacattgtgaatccttagggatctctaaacatctgtgtctttagaagtagtgtcacctctagtaaaagagggccagtagaattgagtggtggcagcctgtgatgtatatgaattttggctgtacgtctctagcgactattttctccaactctatttagtaaaattctacctaatttcagctattgtgcttccaaagtccatgtttgttgaatatgatatggtaaaaaccaatatctatttggagacagtggaggggatggtagtaattgagagacagtgtcagatggagcagtgactttacaatttttttgactgcaatccacaattagacatttcacattgctcccccatgacaacatccctatcgacccctgcccaaaaacaagttatttaccaatcttgctataagcaatgatgactgattttttcttttttctactttatttaaaaagaaaattatagtctcaactctttatattaattttacacacattaattctacagattgttttagcacttagaactaaaagtgttcaagatttgattttgttaccttctctgtgtaagctaaagttgctgacttttctgagtttccattttattgattaaaactgggatagtaatagtattttacaccattttataactttattagaatgacataatctgagtgaagtggttgtgccaggcacttactaaacacacagtcaatgagtatgttctctccgaagtttgttagcttagggaattgggaggatgccactgataataatggtgactcttattcagaggaaaactaattcagttttagacatgctagagtttgaggtagccaaaagagtttagtcatatcacttggaagcaaaccaatgtgaaatagtttcaaataagcaaattttaaaaaatgttaaatgcaaagcaaacagtattaaagctttggggacttaatgattgagtctccttacacctacacaagattggctaaatacacatacaactgtgtcactctaccagatttctgttaacattctccagaatttaaactgcagaatcagtcatttgtatgactgtttgtctctattagcagaggtaatgacatgtatcagtgataggtaattgtggaaaaaaaaacagcacttggaattaaacctagagttggtgattcttacagggtaacccaacggctaccttaatttctatgattcagtttcttcatctacaaaatattatttcacaaagttgcagttgtcaaagggacaagtaaatatgggatccattgtcttcatggaaaaacttttcataaaatgttattttattataataaaaaatgtgtgattggttttcaatttcagattgaatcaaacatagcattctttgtaatagcaggagattaacaacatcccagaatatatctttaaaagaagtatggataaagaaaaacccgtatgcacctctgcacacattttatgtaatagtggtgatactaatttacaaagacaaagtatataggatattaaaagtgaattcttaatacctgatcttgattcttattaaatctgacttatgtgtatacaagatattattagatgaagtgtttgtccagtagcttagcttataaataacccccattctagctcattttaaacaatgtagtatgaatgatgccaaaaacaggctagaacattttcttctttccaagatcttagatttggtaaacaagctactgctcctggaactaatctaggtcatcataacccaaaatcttttgaaatatgagagtcccaattaagtctcttaggtactttttagcattttaattttaagaatgtgtttaactcttaaaacagtatattttggttgctgtttggccatttggtttatttgtaccttgttataatgaatgcaagtcagtgggtaatcattgcagcaaatatgattgctaggaatctcatgtaagtggaagtcaatataatgtatggcttaatttatccctgaactgacctaacatcacattttgttttttaataaaaactggtttaatgatatgataaatttctgtattttccacaactgttaataatgttatattttaactattgcttagtcttcattacaaattattcagctgttaaatgtgttgttcaatgtgacattatttaaaaacttaaaaaaaaatcagcttcacagaaatctttctttgatcaagagttgtctcattcccattgttattaatacagtatacaactaatgta

SEQ ID NO: 132526 - DNA, 3548 bp, Homo sapiens
  Payload ID: 5883
  Gene Symbol: FAM214A
  Gene Name: family with sequence similarity 214, member A
  Uniprot ID: Q32MH5
  ENST ID: ENST00000619572
  CDS Start-End: 96-3326
gaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattgg

SEQ ID NO: 132527 - DNA, 3028 bp, Homo sapiens
  Payload ID: 5884
  Gene Symbol: FAM214B
  Gene Name: family with sequence similarity 214, member B
  Uniprot ID: Q7L5A3
  ENST ID: ENST00000322813
  CDS Start-End: 312-1928
ggtttgcaggcggaggctacagctagggctgctcagtaactgccccaaccactaccacgtccccaagtgcaacgggacccacggaactacagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaa

SEQ ID NO: 132528 - DNA, 3070 bp, Homo sapiens
  Payload ID: 5884
  Gene Symbol: FAM214B
  Gene Name: family with sequence similarity 214, member B
  Uniprot ID: Q7L5A3
  ENST ID: ENST00000378557
  CDS Start-End: 375-1991
agcctagcagagcagggctcagcctgagccaccctttgtctgggttgggggcccgtggcagggaggaccggggaaccaaggggagggaccgggacgggacgggacggaagggcccggagcagcggccacctccgcggagccaatttgggagcgggggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataa

SEQ ID NO: 132529 - DNA, 5771 bp, Homo sapiens
  Payload ID: 5884
  Gene Symbol: FAM214B
  Gene Name: family with sequence similarity 214, member B
  Uniprot ID: Q7L5A3
  ENST ID: ENST00000378561
  CDS Start-End: 3057-4673
aatggcctgtgagtcagaggggcagtggagtcggcggcgcggagccggggcggccccggggagggaccgtcgcagggaggggcgcggcagcggctggggggctgcgggcgccagggcccgctagtgttgcacacgaagctgaacagcgaagagcctagcagagcagggctcagcctgagccaccctttgtctgggttgggggcccgtggcagggaggaccggggaaccaaggggagggaccgggacgggacgggacggaagggcccggagcagcggccacctccgcggagccaatttgggagcggggtgagtgtgctagagggaaagagcaaatctccgaagctccagtatagtatggggcctgtcccaggctgtggggaggagaggagtgagaagggacctgggaggctgggcagggggtaagggatcgtccagaagaaggagtccaggagtcaggtgagtctgcctggcttagtttagagagtctgctaaggtctgctctctcccctctgaagatagagggctctaggctgggggccgaggggttggtaagagagaagaagtcgaccttcctacccacagtggtggtccgtgggaacagcccccctagcttgtgtggatgtatgtagggacaaaatagagagcagctggcagcagttctctttgcataggatgagggtggaaagcacatggataggaattcatcctgtcactctccttgatcatggtagaaatggaaatctttaatactgaagggaaggggagaatgagccttgaagctgatacctataccaatacccacctcacccacctcccaggcctcaaaagtgtctaaaggtacagacgtattctgggacttgttgtttttgctggccttgctccctcagcatgttgggagctgtagtccttgccagccacagcctggcacagctgtttgatgccagctgctgcccaccccctgaacgaagagtgaggcttggcctactctgccctgcccccctcccctgcagtcctgccccatgagtcagcttgaagccatggtctagagccagactggctgggtggcaggggagtgaatatagagcgtcttgttgacagggtgggaactgagagggctctggggttaataagcagatgccaggtatgctggggtcaagtagggcatcatgtcatcccctggcttccccagggcaaggggtcaagagggcaactgggatgacctggaagtggtggtgctagggaaaaggcccctcctgaatctgtatggcttgggtggaggaaagaagggtagaaattagtgcaggttgtaccttctgacaaggttggttgcaggtaggatagtgcaggttgcgattggtgttctgccctttccagccatcccgcccaccacagggaaccaggattttcttagggatcccaattcttaggagaatttggtgaaatgggatagtggggtacaatgatgggaacttggtgtaggagagcttttcagtccctgggtacaaatctctcctttctgcctgctccccacccccacctctgttcctgattttcccttgtacaattaatctctctgcttctctcatctgggaaatttttctctccactctcaggactgctgctcagatgtctgggacttgcattctactttttttgagccctgctgtgtgcttacccctgtacttggggttggatggaggggtgggacacagatctgtcctcaggaactctatggtcggtctagaagatgccttacccacaggagtgagcagaactgttagtgagcttacaggaagtagtaacactgccataggtgaggtctcagagaagggagagatgcttatggtctggggtggacagagcagactttctggaggagatggcatttgacctatccaaggaggaaaagtcttgggtaggcattcaaagggcacttcttgaaggggaaagagcaccgtgaatgtcagacagcaaaagagaaggctgaccctgggggcagctggctttcaacttgacattcccctcaccctagtatgggctggaatagttagtgaagaccatcttatgcacccgtggtttggggttttggtgttgggtgtgtgagcactgggggaggggcgtggagaggtactccctagttgcttccagctgactgactgctgcggccttatctctagtttgcagggccttgcgggagggccctggaaagtgccttctggcagtgaccccttccccttccccttcttgtttttggtcggatttgttgcctcttgttaaagagacaggctgctggaggcaatttggagttcagggctgaaaggccagctctgagctgacttgaaatttgtacctctgaggaccgctgatggggtataactgtgtgggagacctctgcccttagtgccctaggatggcacttgtccctttggagatagacatataagaaggagttgtgcaatttggtggctttgagtaagaaagctgaattcttcccctggccgcctctcagctgacacggtctcttggatcttgggggtctctcatcccttcctccatgtagggcaggagtcctcaaatggtggccctgacaagtagttattctacctcaactcacttgtcacatccttattatactgagccaagacctgcctctttgactccttaggtagcccaactctgccatctgtgccctggaccccaagcctaccctttctgttcctgaagagcctctcacatgggagaaggatgtcctggagtgtactattagcctataattggtgacaggccttaccgctggctccagtgatcctggcttacgtctgttcttctctcctcagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttg

SEQ ID NO: 132530 - DNA, 2566 bp, Homo sapiens
  Payload ID: 5884
  Gene Symbol: FAM214B
  Gene Name: family with sequence similarity 214, member B
  Uniprot ID: Q7L5A3
  ENST ID: ENST00000378566
  CDS Start-End: 756-1457
aaccactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctct

SEQ ID NO: 132531 - DNA, 3256 bp, Homo sapiens
  Payload ID: 5884
  Gene Symbol: FAM214B
  Gene Name: family with sequence similarity 214, member B
  Uniprot ID: Q7L5A3
  ENST ID: ENST00000603301
  CDS Start-End: 540-2156
atcagctggtaggaaatggcctgtgagtcagaggggcagtggagtcggcggcgcggagccggggcggccccggggagggaccgtcgcagggaggggcgcggcagcggctggggggctgcgggcgccagggcccgctagtgttgcacacgaagctgaacagcgaagagcctagcagagcagggctcagcctgagccaccctttgtctgggttgggggcccgtggcagggaggaccggggaaccaaggggagggaccgggacgggacgggacggaagggcccggagcagcggccacctccgcggagccaatttgggagcgggggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaa

SEQ ID NO: 132532 - DNA, 3016 bp, Homo sapiens
  Payload ID: 5884
  Gene Symbol: FAM214B
  Gene Name: family with sequence similarity 214, member B
  Uniprot ID: Q7L5A3
  ENST ID: ENST00000605244
  CDS Start-End: 300-1916
actttgtctcctccttcctcctttggggccgccaccgccaatcagagccagcggatcctggttggagtgcgaccgcccggggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaa

SEQ ID NO: 132533 - DNA, 2999 bp, Homo sapiens
  Payload ID: 5884
  Gene Symbol: FAM214B
  Gene Name: family with sequence similarity 214, member B
  Uniprot ID: Q7L5A3
  ENST ID: ENST00000488109
  CDS Start-End: 283-1899
attctgggcagaagctctcctatcccacttccctgtatgctctgtctccttgaacatgggcctggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaa

SEQ ID NO: 132534 - DNA, 1582 bp, Homo sapiens
  Payload ID: 5885
  Gene Symbol: FAM216A
  Gene Name: family with sequence similarity 216, member A
  Uniprot ID: Q8WUB2
  ENST ID: ENST00000377673
  CDS Start-End: 513-1334
gagaaacgcgtcctgagaaaaaaggggaggggcgagggagaggatttgcgcgtgcgcaaaagtagttgatggaaatcggccgttgggatgctgtctaagcttggatacctgagtaataacggacaacagataaagctccgcatccttgcgccacgtgcttcggtccgtggtttgcgtgcagacgtttgacctgtatggtgaccctcgcgatttgcaaatgtgctgaggatctggaatactgaagtggaaggcacctcttgttttggggagcatgtatatttccctcctgtgacgcactgcttccacagagaggtgcaaacgtgcaaacgctcagcgaccgcagcgctcctgcccctcccccaccgtaactccggggtcgcggatctgcccgccccgctctcccgaagctgttcgggcagtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccagggtccggggtccgactggacggagcgtagctcttctgcagagccgcccgctgtggccgggaccgagggtggcggcggcggatcagctggatactcttgttaccagaattccaaaggttctgatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaaaaaggaagaagatttactaaataattttatgcaatcaatgtcaattgaagaacagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaa

SEQ ID NO: 132535 - DNA, 929 bp, Homo sapiens
  Payload ID: 5885
  Gene Symbol: FAM216A
  Gene Name: family with sequence similarity 216, member A
  ENST ID: ENST00000548449
  CDS Start-End: 96-329
agtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccagggtccggggtccgactggacggagcgtagctcttctgcagagccgcccgctgtggccgggaccgagggtggcggcggcggatcagctggatactcttgttaccagaattccaaaggttctgcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggtctgtttcttagtgtaaaaggggggaaatgcatctcagtttaatttttttttttctcagacagggttttgttctctcacccaggctggagtgtagtggtgtgatacagtttactgtattctcaaactcctgggctcaagcaatgctcctgcctcagactcccaagtagctagggctaaaggcacaaaccaccatgccctgctagttaaaaaaaattgtttgtacagaaagcatctcactatgttggccaaggtactctcacctccgcctcccaaagcactgggattacaggcgtgagctactgtgcccagccttccccatctcttttgaagggta

SEQ ID NO: 132536 - DNA, 3243 bp, Homo sapiens
  Payload ID: 5886
  Gene Symbol: FAM216B
  Gene Name: family with sequence similarity 216, member B
  Uniprot ID: Q8N7L0
  ENST ID: ENST00000313851
  CDS Start-End: 65-484
acactgaataggaatggcagcttttaaaagtgggggaactacagtatagggtataggataaacgatgggacaaaactggaaaagacaacaaaagctttggaatgttccacaacttccttttattcgagttcctccctccatctatgacacttccttactaaaggccctcaaccaagggcaacagcgctacttttacagcattatgaggatttacaactccaggccccagtgggaggccctgcagacccgctacattcacagccttcagcaccaacagctgcttggctatattactcaacgggaagccttgtcttatgctcttgtacttagagattcaaccaagagagcctcagccaaggtagctcctcaaagaaccattccccggaaaacttcagccatgacaagaagatgtccatcagtactacctgtatctgtggttctacctagggcccaaagtaaaaggcgccaagtgctcaggaactgagacttggcagcattttcagaaacaggaagtttgcccatgtatccctggtatctagtgggtgctttgtgcatatttgttgaatgacagtgaataatttctaatataaaccccagacctaaaaataatctctgattcatataaattttgccagcaagaccaagaggtttaagagcaatggagccgagagtaagcaagcctttccacataacatccgtagagtaaaaggacttttaaagctttcaaagtaaaagtttactttggattagaacctcctagagaagtccccaaaacagtgaaaggggacaagtgaccagaaagggccaggtcctctgtcactgggtgaccatttctagcaaactatcatgtatacattttgaaaatatacaaaacaacacaggattaacactgatcatagagggcttacaaaatcatatcatcccagcaacaattggcctgtgcatttccttcctctcctcttccccatcaggcaatggcatttaatttagccccaaagctcttctagttctcacctggcttgatcactttgtgtcatcttgaaacatgcacttatcagtctaccacagctgaattgattttatggagctgtaactggccttgacatgggtaagagaattcatgcacacatctttccctggcagctgaagaaacactcttaaaagaatatgaaataaccccgaagactttatttcatgtccaacctttctgtggcctcaaatgttttaagcaaagcacataaaactatactaagcagtgagtcagttcatcatacaaaggcatagtattgcattagttatatttaatggttattttcatcaccagagattttgtgtgtgtgtgtgtgtgtgtgtgtgtgtgtgttaaaaatcagtcaccagtgctcatgtaaagtcaaaacaaaaaaatgcttcttcctcatcattgtaaaatacgtcaccccattcaaatcagctgatgcctatgaaaggaattggttgaggtggaatataaattttattgacaagggatgtgctaacattgatctgaaaggaatatgctgcattattatcagaaaaaaaatcattatcttctctttgcaatcatgaacatataagatataaaaattgtcatgagattctgaacactagtattgaggtccagcactacttccaagctcctatctgacttttctttgggaggaatgggaagtgtggttggcccactagtctgataagaagtcttggtgaagctaatactgaccttgctggggtcattcacttaatcataaagaagcttcttgacctctgcaaattctggccctgacatgtattctaaatacctttacagttctaagtgagaaattgttacataggcttagaagaagaaaagactccagtgggactgggatgagctgcgtggtagccctcataaagcagagaggttggtgggagacctaacttggcctatactagccttcccattgttttcacaatgggccttttatcccctctgaactgcttgcctgcacttttatcttagacttttttttttgatgagcataggtatttgctgtgtaagccttatctagtgatgcagaatatcaaggaggccacttacaattctaagctgcatccctgtatcaaaaatctcagaagcaccttgcatctgatagaggcttgtaagagcagattgacaggtgaatgtcacaggtccataagaaggacaaatagatctaagttgggcaaaagattctatttgttggttctcccttctaagatgataatatgcccctgcacttgagaccttacttgaaacttaaagaaatgtgattggttatggtgctgggagaaaggggtgcacctgggaggacactgagaaagataaacaaaggggaaggaagagaggacaacctgtaacttttagaaaaggctactacttttaactgttggagaaaatgctattgcttgcactcacaatgtcaatatacattatcagaacttaagtcctggagatcagagactgtttcacctgaaattgctagcacctagaatggcccccggttgcggtaggcaatcaataatactctttgaataataatgaggttttcaaagattctgcaagtcagactggcctctggctttgtgatattattctagagtcccagtaacccacaattgttgatgaggagtagcagtagaatatcaaggacaggtgatgagacaacaagtctatcccgcaaagggcagggaatagagggtacactggaaagaatttgaaaacaataataaagctgactacaagttggtctattttttattaccaccatgagccagcaattctaaataatatcagtgataaagtattcatcccccaaaatattttattgaactaggttctaaacaatttctgaggttactgttgagttttaaataatacatatatgtaagcttcaaagtagcacatttgtactgtttttcttcaataatcattttactccacatggaaactaattcagggaatatcctgctatatagttggctctcagtacatatggtgtcagctcatgtgtctccagcccctgtagtactatatattattgcatttaaatgatggatttgaaataaacaatgattataccatgattgtaaagacaagaaacagaacctgaaatacttcaatttttgattctatgtggcagtttagagttttttaaaacaatttttatgtataatttatatgcaataaatgccctcaaagttcaa

SEQ ID NO: 132537 - DNA, 3300 bp, Homo sapiens
  Payload ID: 5886
  Gene Symbol: FAM216B
  Gene Name: family with sequence similarity 216, member B
  Uniprot ID: Q8N7L0
  ENST ID: ENST00000537894
  CDS Start-End: 124-543
atcagcttatcaacagacttccaccaccaccaccagcatataaacagagtccgcgtaagaaaactacactgaataggaatggcagcttttaaaagtgggggaactacagtatagggataaacgatgggacaaaactggaaaagacaacaaaagctttggaatgttccacaacttccttttattcgagttcctccctccatctatgacacttccttactaaaggccctcaaccaagggcaacagcgctacttttacagcattatgaggatttacaactccaggccccagtgggaggccctgcagacccgctacattcacagccttcagcaccaacagctgcttggctatattactcaacgggaagccttgtcttatgctcttgtacttagagattcaaccaagagagcctcagccaaggtagctcctcaaagaaccattccccggaaaacttcagccatgacaagaagatgtccatcagtactacctgtatctgtggttctacctagggcccaaagtaaaaggcgccaagtgctcaggaactgagacttggcagcattttcagaaacaggaagtttgcccatgtatccctggtatctagtgggtgctttgtgcatatttgttgaatgacagtgaataatttctaatataaaccccagacctaaaaataatctctgattcatataaattttgccagcaagaccaagaggtttaagagcaatggagccgagagtaagcaagcctttccacataacatccgtagagtaaaaggacttttaaagctttcaaagtaaaagtttactttggattagaacctcctagagaagtccccaaaacagtgaaaggggacaagtgaccagaaagggccaggtcctctgtcactgggtgaccatttctagcaaactatcatgtatacattttgaaaatatacaaaacaacacaggattaacactgatcatagagggcttacaaaatcatatcatcccagcaacaattggcctgtgcatttccttcctctcctcttccccatcaggcaatggcatttaatttagccccaaagctcttctagttctcacctggcttgatcactttgtgtcatcttgaaacatgcacttatcagtctaccacagctgaattgattttatggagctgtaactggccttgacatgggtaagagaattcatgcacacatctttccctggcagctgaagaaacactcttaaaagaatatgaaataaccccgaagactttatttcatgtccaacctttctgtggcctcaaatgttttaagcaaagcacataaaactatactaagcagtgagtcagttcatcatacaaaggcatagtattgcattagttatatttaatggttattttcatcaccagagattttgtgtgtgtgtgtgtgtgtgtgtgtgtgtgtgttaaaaatcagtcaccagtgctcatgtaaagtcaaaacaaaaaaatgcttcttcctcatcattgtaaaatacgtcaccccattcaaatcagctgatgcctatgaaaggaattggttgaggtggaatataaattttattgacaagggatgtgctaacattgatctgaaaggaatatgctgcattattatcagaaaaaaaatcattatcttctctttgcaatcatgaacatataagatataaaaattgtcatgagattctgaacactagtattgaggtccagcactacttccaagctcctatctgacttttctttgggaggaatgggaagtgtggttggcccactagtctgataagaagtcttggtgaagctaatactgaccttgctggggtcattcacttaatcataaagaagcttcttgacctctgcaaattctggccctgacatgtattctaaatacctttacagttctaagtgagaaattgttacataggcttagaagaagaaaagactccagtgggactgggatgagctgcgtggtagccctcataaagcagagaggttggtgggagacctaacttggcctatactagccttcccattgttttcacaatgggccttttatcccctctgaactgcttgcctgcacttttatcttagacttttttttttgatgagcataggtatttgctgtgtaagccttatctagtgatgcagaatatcaaggaggccacttacaattctaagctgcatccctgtatcaaaaatctcagaagcaccttgcatctgatagaggcttgtaagagcagattgacaggtgaatgtcacaggtccataagaaggacaaatagatctaagttgggcaaaagattctatttgttggttctcccttctaagatgataatatgcccctgcacttgagaccttacttgaaacttaaagaaatgtgattggttatggtgctgggagaaaggggtgcacctgggaggacactgagaaagataaacaaaggggaaggaagagaggacaacctgtaacttttagaaaaggctactacttttaactgttggagaaaatgctattgcttgcactcacaatgtcaatatacattatcagaacttaagtcctggagatcagagactgtttcacctgaaattgctagcacctagaatggcccccggttgcggtaggcaatcaataatactctttgaataataatgaggttttcaaagattctgcaagtcagactggcctctggctttgtgatattattctagagtcccagtaacccacaattgttgatgaggagtagcagtagaatatcaaggacaggtgatgagacaacaagtctatcccgcaaagggcagggaatagagggtacactggaaagaatttgaaaacaataataaagctgactacaagttggtctattttttattaccaccatgagccagcaattctaaataatatcagtgataaagtattcatcccccaaaatattttattgaactaggttctaaacaatttctgaggttactgttgagttttaaataatacatatatgtaagcttcaaagtagcacatttgtactgtttttcttcaataatcattttactccacatggaaactaattcagggaatatcctgctatatagttggctctcagtacatatggtgtcagctcatgtgtctccagcccctgtagtactatatattattgcatttaaatgatggatttgaaataaacaatgattataccatgattgtaaagacaagaaacagaacctgaaatacttcaatttttgattctatgtggcagtttagagttttttaaaacaatttttatgtataatttatatgcaataaatgccctcaaagttc

SEQ ID NO: 132538 - DNA, 2265 bp, Homo sapiens
  Payload ID: 5887
  Gene Symbol: FAM217A
  Gene Name: family with sequence similarity 217, member A
  Uniprot ID: Q8IXS0
  ENST ID: ENST00000274673
  CDS Start-End: 405-1931
ggcccgcgaatacgcgtggaccttgtggaacgccgggcctccccgggcgcccccgctctctggtagttgccgggagacccggccggtggggaagcccgcggagccgcagccccggccccggaaggtctctctgggccccgggcccgactcccacccctgcgccggcccgcgggcttcgcaggccctgcactgccgaccgggctgcgctcaaggccgccagccgcccgccgccctctttgtccccccgctgcaggaaggccgcggcagagggggcgccctccaagccgtcagccacgcacgcggaggcgctcgggcctcggggcggcgcaccgggagagcacgccggggaggacacgtgggccttcgcgcggattttaaggaaacagagcaacagctacaacaaaatggggagaagaaatgagaactgtgctaacagcctacgtgtgtcaaacatctctcaggagaacttatctcactggaatttggattcagaagtacctgtttctgaaaataaaaacctcccagctggaagggatggagcagcaggtggcaaaattaacaagaactatttggaaattccagtggagcaactgatgctagaacctaatttgtcggtgcatagtcaaaaaagtacacagaatagtaaacaagggatctttcaattatggaattgtcctcttaatgaaggaagtaccatagagaagagggaattcaaaaaatcttcagtggaaactggctttaatgtaatcaatcatcctataagggtcttcactctgaaccacccattaacaattgcttcagttgataagcaagttggtccttaccctggactgccaatgccattaggtctctgctggccctatgctgatggagacttttttaagaacagaaatgagattcatgttagttcatgttcaactatagaaaacaatgatggtgaaacattacctgctccaaattggaatttgaaacatggaaacagcagtgtggaagaaaatttcacagatgaaagtgatttatcagaaaatgagaagacaaatgatactttactcagctattttaaaaaggtggacctgaacttgaagccagaaacaataaaaaatgttgaggaacctttcaccgaggagccaaatgaagtatttccatatcctgattttctccctcctcctttcagtgctctagacttgcacaatttagccctctccaaatctgacaattggaaagtgacagtggaccctgcagaaacctctgttgaacacttgataactcgtttactggaactagaacgattacaacatatgactattcaaaaagagaggccaagactacaaacgactttctgtactccagcagttactgaacgaccctcttcctccaaagctacaccaaaagtgagacagccaaaactttgcgactctttgagtcttcagataccttgtgtagataaaagtcaagaaaaaagtaaaaacaactctggttcttgtaagcttgaacaaaatgctttaaaacggaattggagcaatgctggcaaatatagatggaattctagaccactgtctctaaaaagttcttccaccccaaaacaattgattgaaacttatgataagaatcccaaaagttctattttaagtccatgccaagaactctcattcaaacctactattggccatacaaatcaatcaatggttaaaatggtctccacaagatgtctgccatggaggtctccaatgccagtttcacctatacctctgacttttcccgaaaatcagaaggaagaaattaaggcaccgaagagaaactttgggaccaaaaagaaactttaccgacaaaatatagtgttgaatagaccattctctattcagaagctaaactgtttgtcgccttcccttattgctaaggataagtgctgctcacccattgaacaaaaataactcttttctttcatacatctcaatgtgaacacatctactctaagaagcccaactaagatatggttaattattccaagacacaggtactattaacagtcccccaaaatcaccaaacagttgcttgatgtgatatggagtagaacttgtgaaaagcactgctgagatgtctatatataaacccacaggcttctatactgacatatttcacaatcttttgcatgttgtgtttcaagtaaatggttcacttggtagactattctattcaaaaggctactcttttttcagtgattgttttccagtataattccatcaataaatggtataattgacttat

SEQ ID NO: 132539 - DNA, 474 bp, Homo sapiens
  Payload ID: 5887
  Gene Symbol: FAM217A
  Gene Name: family with sequence similarity 217, member A
  ENST ID: ENST00000492651
  CDS Start-End: 379-474
aaggtctctctgggccccgggcccgactcccacccctgcgccggcccgcgggcttcgcaggccctgcactgccgaccgggctgcgctcaaggccgccagccgcccgccgccctctttgtccccccgctgcaggaaggccgcggcagagggggcgccctccaagccgtcagccacgcacgcggaggcgctcgggcctcggggcggcgcaccgggagagcacgccggggaggacacgtgggccttcgcgcgaacttatctcactggaatttggattcagaagtacctgtttctgaaaataaaaacctcccagctggaagggatggagcagcaggtggcaaaattaacaagaactatttggaaattccagtggagcaactgatgctagaacctaatttgtcggtgcatagtcaaaaaagtacacagaatagtaaacaagggatctttcaattatggaattgtcctcttaatgaagga

SEQ ID NO: 132540 - DNA, 470 bp, Homo sapiens
  Payload ID: 5887
  Gene Symbol: FAM217A
  Gene Name: family with sequence similarity 217, member A
  ENST ID: ENST00000498677
  CDS Start-End: 328-470
ggggaagcccgcggagccgcagccccggccccggaaggtctctctgggccccgggcccgactcccacccctgcgccggcccgcgggcttcgcaggccctgcactgccgaccgggctgcgctcaaggccgccagccgcccgccgccctctttgtccccccgctgcaggaaggccgcggcagagggggcgccctccaagccgtcagccacgcacgcggaggcgctcgggcctcggggcggcgcaccgggagagcacgccggggaggacacgtgggccttcgcgcggcaaaattaacaagaactatttggaaattccagtggagcaactgatgctagaacctaatttgtcggtgcatagtcaaaaaagtacacagaatagtaaacaagggatctttcaattatggaattgtcctcttaatgaaggaagtaccatagagaagagggaattcaaaaaatcttcagtggaaactgg

SEQ ID NO: 132541 - DNA, 5152 bp, Homo sapiens
  Payload ID: 5888
  Gene Symbol: FAM217B
  Gene Name: family with sequence similarity 217, member B
  Uniprot ID: Q9NTX9
  ENST ID: ENST00000358293
  CDS Start-End: 416-1567
atcccccccacccccgccaacgctcgccggggtcgcccgaggcctgagccaagggggacgctgtgggcgcggctcaggccaggccctcagtgctctggctattgctgaaaacaccttctagttccaccttgtaactggactcccaaaagatgaatgctgacatcttctgatgcttaacaagaaataaaaatagtcaccttaatcatcaaaaagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttgtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttgttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatattgtctgga

SEQ ID NO: 132542 - DNA, 5036 bp, Homo sapiens
  Payload ID: 5888
  Gene Symbol: FAM217B
  Gene Name: family with sequence similarity 217, member B
  Uniprot ID: Q9NTX9
  ENST ID: ENST00000360816
  CDS Start-End: 300-1451
ctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttgtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttgttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatattgtctgga

SEQ ID NO: 132543 - DNA, 419 bp, Homo sapiens
  Payload ID: 5888
  Gene Symbol: FAM217B
  Gene Name: family with sequence similarity 217, member B
  ENST ID: ENST00000421092
  CDS Start-End: 277-419
tgaaaaaccaacccgatactggtggtaggaccatttgcaatcaatagttactgacagtattctgttgcttctagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaact

SEQ ID NO: 132544 - DNA, 2175 bp, Homo sapiens
  Payload ID: 5889
  Gene Symbol: FAM218A
  Gene Name: family with sequence similarity 218, member A
  Uniprot ID: Q96MZ4
  ENST ID: ENST00000513876
  CDS Start-End: 76-549
gcttcgacttccgggtgagaccgtgaaggtgtggcgcgacgttggagaccggggcagcgccatgtaccacagtggatggaaggatgcgcggtgcggcggggcagctgtcctcttctccccggacccagcgcctggagagccagccctgcagggtgggctgggcgagccaaactgcgttcctggtgcagggcttcgggtctccctaacagaccttatacgctgaccggcggccgccatggcagtgtctctttgctcagacatccagggacgaccacattcgtccaacagcggtcgctccaccaatcctgggagaagcgaatcgttttctccgcgtgccctgtcagccgctcatggtgcccagagaggaattttagtggcagcattccggctgtcacgccaccgaaattgccaggccactccaagtcagaaggaccaccaggaaaagtcaggaagagaaccaccatcaggtcccagcctctttttgtgacaaggactagagggtttgggtctgcagtgggctggctcccgctgggctcacctgtcctatagagcaggctgcctcaaggaagaagctcacaggggacatctgacatctgaaacagcaagtgtaaaatgctttaaataagccaaaactaaaccaatcgttatgttaactaaaaatacatgaatgctaccgaagatagtcgaatattagaggaagagattaaactctgattttgagcactttgtgctttattcggaaaatgaataagatgcagttctgaaaacctgaaaatataaagaataggatatgatacgcacactagatgaaaacaaaactttcagaccatattttcttatttaaagctctaataagtgagatagcagagtaaactattcactcaaataattagtaactgatataagggtatgtatcaataacaggtattaagacaaaaactttatgagcttttccattttaacaagggatgatgattctagacttctgccacaacattatggtcgacaaaacattcttaattcattttacatagatctgactctagattctgaaacagcaagtcataatcttgtatctctaaagatagaatacagtgcgatttggaaagacaccacaaaaactcatgatccaaaaaagattaaggctgttattaccaggaggaagagaaagaggacaaaatcaaactggatagatataatagagttgtttgttagaattgtcttcccaggagatggaaaaagacgccatcacaataggattcatgctttagttttcagctatagaaatgtaataactttgccaaagtaattacactacatagagtggcaatcgttctattaaaagtaagacccagtaatgttaggatttgttctggacaatgaaggggatgaggtttaatcttatgacttgaatgccaggtctgaaatcttttcttcaagtgatatttttatgaaactacttaggctgtgtttcacactgggtatgatttctaacctcttataacctgtacagtaatagattatgaaggatgaattatttgaaagctattttgtattatttaggagaggagctcttcaattctgaattgtctgccacttacaagcagaagaaagtttttttctttcattattttagcaactatcaataaaacagtattagaaatgcctactcttcagagatgtaatgggaataaattgtaaagtacttttgatattctaagatgaaagatggtattacacagtcaataattcaatgcttcccacattatgaattttatcaaaattatgtagagagctattagttcattccagcaacaaaacaggcttatataaaaacaaaaacctcctgggtcatgccatcctacaccaaattcctgttaaacagaggcatgatttattccagtgaccttgctatttcttcataactgtaatatgtctaatgttagacattttaaattaacattctattagataaactgagaatttaggtctctcgcaccacccaggcacatactctatctttccccacaaatatccaaatatggtaatataattggattaatacgttcatatgactatataattgttcacagctgagccacttaggtgctataattataatttctttgatacacaaattttgttttattgtgattaaaattgcctgatttctta

SEQ ID NO: 132545 - DNA, 3588 bp, Homo sapiens
  Payload ID: 5890
  Gene Symbol: FAM219A
  Gene Name: family with sequence similarity 219, member A
  Uniprot ID: Q8IW50
  ENST ID: ENST00000297620
  CDS Start-End: 308-814
gagtcaccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaac

SEQ ID NO: 132546 - DNA, 770 bp, Homo sapiens
  Payload ID: 5890
  Gene Symbol: FAM219A
  Gene Name: family with sequence similarity 219, member A
  ENST ID: ENST00000379078
  CDS Start-End: 293-763
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacaggtgtgtatgggggcttgggggtagctgggcagcccaaaggaacctgtatagcacaagtgggctgtacaggccacacctgctatattgtcagaattgggatattcttcagccagaatctctccaagggtgaattctcc

SEQ ID NO: 132547 - DNA, 3591 bp, Homo sapiens
  Payload ID: 5890
  Gene Symbol: FAM219A
  Gene Name: family with sequence similarity 219, member A
  ENST ID: ENST00000379080
  CDS Start-End: 293-811
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 132548 - DNA, 3543 bp, Homo sapiens
  Payload ID: 5890
  Gene Symbol: FAM219A
  Gene Name: family with sequence similarity 219, member A
  ENST ID: ENST00000379081
  CDS Start-End: 293-763
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 132549 - DNA, 893 bp, Homo sapiens
  Payload ID: 5890
  Gene Symbol: FAM219A
  Gene Name: family with sequence similarity 219, member A
  ENST ID: ENST00000379084
  CDS Start-End: 293-787
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaaccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 132550 - DNA, 3573 bp, Homo sapiens
  Payload ID: 5890
  Gene Symbol: FAM219A
  Gene Name: family with sequence similarity 219, member A
  ENST ID: ENST00000379087
  CDS Start-End: 293-793
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 132551 - DNA, 3624 bp, Homo sapiens
  Payload ID: 5890
  Gene Symbol: FAM219A
  Gene Name: family with sequence similarity 219, member A
  ENST ID: ENST00000379089
  CDS Start-End: 293-844
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 132552 - DNA, 3644 bp, Homo sapiens
  Payload ID: 5890
  Gene Symbol: FAM219A
  Gene Name: family with sequence similarity 219, member A
  Uniprot ID: Q8IW50
  ENST ID: ENST00000445726
  CDS Start-End: 308-865
gagtcaccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcc

SEQ ID NO: 132553 - DNA, 798 bp, Homo sapiens
  Payload ID: 5890
  Gene Symbol: FAM219A
  Gene Name: family with sequence similarity 219, member A
  ENST ID: ENST00000422409
  CDS Start-End: 293-798
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccac

SEQ ID NO: 132554 - DNA, 3550 bp, Homo sapiens
  Payload ID: 5891
  Gene Symbol: FAM219B
  Gene Name: family with sequence similarity 219, member B
  Uniprot ID: Q5XKK7
  ENST ID: ENST00000357635
  CDS Start-End: 322-918
aaaccgtgggcacccgaccgacgcacacgcgcagccccacgacagtatcagtatttaatttccactagagacagaactaagcctaaccatcaccaggctcaagccgcctaccccaaaaccgagaacggaactgcccggtccccccgaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttga

SEQ ID NO: 132555 - DNA, 587 bp, Homo sapiens
  Payload ID: 5891
  Gene Symbol: FAM219B
  Gene Name: family with sequence similarity 219, member B
  ENST ID: ENST00000562698
  CDS Start-End: 84-587
gttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagaggtgaaccaggatgtgagccggcagctgcttcaggatgggtatcacctggatgagattccagatgacgaggacttg

SEQ ID NO: 132556 - DNA, 699 bp, Homo sapiens
  Payload ID: 5891
  Gene Symbol: FAM219B
  Gene Name: family with sequence similarity 219, member B
  ENST ID: ENST00000566194
  CDS Start-End: 49-312
ctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggtcagtgaagtttaacaagggctatactgctcttagccagagtccagatgaaaacctggtgtccctcgactctgacagtgatggggagctgggatccagatactcctccgggtattcatctgcagaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccct

SEQ ID NO: 132557 - DNA, 449 bp, Homo sapiens
  Payload ID: 5891
  Gene Symbol: FAM219B
  Gene Name: family with sequence similarity 219, member B
  ENST ID: ENST00000567388
  CDS Start-End: 1-209
ccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacaggcccttcatgtacattccagggccgttctcttctgaacaatatcccttcccaggatggcttggttagaagactcatagtgatggggagctgggatccagatactcctccgggtattcatctgcagaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaag

SEQ ID NO: 132558 - DNA, 2721 bp, Homo sapiens
  Payload ID: 5891
  Gene Symbol: FAM219B
  Gene Name: family with sequence similarity 219, member B
  Uniprot ID: Q5XKK7
  ENST ID: ENST00000563119
  CDS Start-End: 38-634
ggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacacta

SEQ ID NO: 132559 - DNA, 533 bp, Homo sapiens
  Payload ID: 5891
  Gene Symbol: FAM219B
  Gene Name: family with sequence similarity 219, member B
  ENST ID: ENST00000569761
  CDS Start-End: 81-302
aaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcgtcagtgaagtttaacaagggctatactgctcttagccagagtccagatgaaaacctggtgtccctcgactctgacagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccct

SEQ ID NO: 132560 - DNA, 1249 bp, Homo sapiens
  Payload ID: 5891
  Gene Symbol: FAM219B
  Gene Name: family with sequence similarity 219, member B
  ENST ID: ENST00000565772
  CDS Start-End: 293-631
gcgcaccctccattcaagccaagctgcgtgagtgtggcccgatggtcgggggaggtttctccctgggcgggcggccgcgtccccagggcgggttccggagctccgctgggcctcggccccggagggaaggggttagctgcagcctgctctcgcccctcaaaatccgttcggaaagagcggcctcccagccttcgggagacgcggcggagtggggaagacccggctgacccgggtcctttaacttccagagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctg

SEQ ID NO: 132561 - DNA, 865 bp, Homo sapiens
  Payload ID: 5891
  Gene Symbol: FAM219B
  Gene Name: family with sequence similarity 219, member B
  ENST ID: ENST00000563671
  CDS Start-End: 1-590
ccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggttgcacctgtctaactatgacagggatcatagcaggttgcttaatgatacagcaggatcctggcttccagaatccctggacctggggcatccccaactggtccaaccgtccgggtgacagtttcctgaggagaggggtgtatccaggcttacctcccagcaggagtggtaccatatggtgtttatgtactactctatagaactcttggcttgcacttctacagctctgtacatttataagaataaatgcaatcacacta

SEQ ID NO: 132562 - DNA, 742 bp, Homo sapiens
  Payload ID: 5891
  Gene Symbol: FAM219B
  Gene Name: family with sequence similarity 219, member B
  ENST ID: ENST00000563877
  CDS Start-End: 84-305
gttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcgtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccaga

SEQ ID NO: 132563 - DNA, 568 bp, Homo sapiens
  Payload ID: 5891
  Gene Symbol: FAM219B
  Gene Name: family with sequence similarity 219, member B
  ENST ID: ENST00000564019
  CDS Start-End: 8-403
cccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagggccgttctcttctgaacaatatcccttcccaggatggcttggttagaagactcatagtgatggggagctgggatccagatactcctccgggtattcatctgcagaggtgaaccaggatgtgagccggcagctgcttcaggatgggtatcacctggatgagattccagatgacgaggactt

SEQ ID NO: 132564 - DNA, 673 bp, Homo sapiens
  Payload ID: 5891
  Gene Symbol: FAM219B
  Gene Name: family with sequence similarity 219, member B
  ENST ID: ENST00000563413
  CDS Start-End: 6-227
cggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcgtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggttgcacctgtctaactatgacagggatcatagcaggttgcttaatgatacagcaggatcctggcttccagaatccctggacctggggcatccccaactggtccaaccgtccgggtgagtttagtgattctggtttgcccttcc

SEQ ID NO: 132565 - DNA, 1552 bp, Homo sapiens
  Payload ID: 5891
  Gene Symbol: FAM219B
  Gene Name: family with sequence similarity 219, member B
  Uniprot ID: Q5XKK7
  ENST ID: ENST00000563069
  CDS Start-End: 81-527
aaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacaggcccttcatgtacattccagggccgttctcttctgaacaatatcccttcccaggatggcttggttagaagactcatagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagatta

SEQ ID NO: 132566 - DNA, 624 bp, Homo sapiens
  Payload ID: 5891
  Gene Symbol: FAM219B
  Gene Name: family with sequence similarity 219, member B
  ENST ID: ENST00000566132
  CDS Start-End: 1-33
gaacaatatcccttcccaggatggcttggttagaagactcatagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggttgcacctgtctaactatgacagggatcatagcaggttgcttaatgatacagcaggatcctggcttccagaatccctggacctggggcatccccaactggtccaaccgtccggggtctctgtcacccaggctggagtgcagtggtgtaatcacagctcactgcagcctcaacctcccaggcccaagcagtcctcccacatggtgacagtttcctgaggagaggggtgtatccaggcttacctcccagcaggagtggtaccatatggtgtttatgtactactctatagaactcttggcttgcacttctacagctctgtacatttataagaataaatgcaatcacacta

SEQ ID NO: 132567 - DNA, 3219 bp, Homo sapiens
  Payload ID: 5891
  Gene Symbol: FAM219B
  Gene Name: family with sequence similarity 219, member B
  ENST ID: ENST00000569524
  CDS Start-End: 84-305
gttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcgtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacacta

SEQ ID NO: 132568 - DNA, 1145 bp, Homo sapiens
  Payload ID: 5891
  Gene Symbol: FAM219B
  Gene Name: family with sequence similarity 219, member B
  ENST ID: ENST00000570143
  CDS Start-End: 43-264
ccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcgtcagtgaagtttaacaagggctatactgctcttagccagagtccagatgaaaacctggtgtccctcgactctgacaggcccttcatgtacattccagggccgttctcttctgaacaatatcccttcccaggatggcttggttagaagactcatagtgatggggagctgggatccagatactcctccgggtattcatctgcagaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttca

SEQ ID NO: 132569 - DNA, 2214 bp, Homo sapiens
  Payload ID: 5892
  Gene Symbol: FAM220A
  Gene Name: family with sequence similarity 220, member A
  Uniprot ID: Q7Z4H9
  ENST ID: ENST00000313324
  CDS Start-End: 469-1248
cggccaggctggtacaggcggctgctcgcggaggcacttctccgagcgtgacgtgcggactccgctccactgcggcccgcccgcccgccggtctagccgccgcctccttcgctccctgagcacgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcggcgagactggctgggaggagggcccagggccactgacggccacagaggacagtgccccaaaggagagcctcgggtgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacgatcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgaattcgtggtaagctgttaccatgtctacattttgtagaatgattttggtctgcagcaaaattcgatttcacttctcatacccctttccttccacttgaaatgcaatttagacagaggccctgtggtgaaagttgcaatattaagtttacctttagaagatcccttctcaaactcagaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagcttaataaatatgtcttattttata

SEQ ID NO: 132570 - DNA, 502 bp, Homo sapiens
  Payload ID: 5892
  Gene Symbol: FAM220A
  Gene Name: family with sequence similarity 220, member A
  ENST ID: ENST00000524898
  CDS Start-End: 143-502
attgttgtccggcaggtcagctgggcagggatctgcgaggaaggtgaccgctcctgttgtggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagt

SEQ ID NO: 132571 - DNA, 558 bp, Homo sapiens
  Payload ID: 5892
  Gene Symbol: FAM220A
  Gene Name: family with sequence similarity 220, member A
  ENST ID: ENST00000530143
  CDS Start-End: 232-558
gtgacgtcaggctgcgcggccaggctggtacaggcggctgctcgcggaggcacttctccgagcgtgacgtgcggactccgctccactgcggcccgcccgcccgccggtctagccgccgcctccttcgctccctgagcacgccaggcgagggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgct

SEQ ID NO: 132572 - DNA, 207 bp, Homo sapiens
  Payload ID: 5892
  Gene Symbol: FAM220A
  Gene Name: family with sequence similarity 220, member A
  ENST ID: ENST00000578372
  CDS Start-End: 1-207
atggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattga

SEQ ID NO: 132573 - DNA, 2211 bp, Homo sapiens
  Payload ID: 5892
  Gene Symbol: FAM220A
  Gene Name: family with sequence similarity 220, member A
  Uniprot ID: Q7Z4H9
  ENST ID: ENST00000616824
  CDS Start-End: 469-1248
cggccaggctggtacaggcggctgctcgcggaggcacttctccgagcgtgacgtgcggactccgctccactgcggcccgcccgcccgccggtctagccgccgcctccttcgctccctgagcacgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcggcgagactggctgggaggagggcccagggccactgacggccacagaggacagtgccccaaaggagagcctcgggtgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacgatcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgaattcgtggtaagctgttaccatgtctacattttgtagaatgattttggtctgcagcaaaattcgatttcacttctcatacccctttccttccacttgaaatgcaatttagacagaggccctgtggtgaaagttgcaatattaagtttacctttagaagatcccttctcaaactcagaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagcttaataaatatgtcttatttt

SEQ ID NO: 132574 - DNA, 1472 bp, Homo sapiens
  Payload ID: 5893
  Gene Symbol: FAM221A
  Gene Name: family with sequence similarity 221, member A
  Uniprot ID: A4D161
  ENST ID: ENST00000344962
  CDS Start-End: 90-986
ggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgcctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 132575 - DNA, 1136 bp, Homo sapiens
  Payload ID: 5893
  Gene Symbol: FAM221A
  Gene Name: family with sequence similarity 221, member A
  Uniprot ID: A4D161
  ENST ID: ENST00000409994
  CDS Start-End: 36-650
ggtccgcagggaagcctttggcttccccaccggcaatggagcggttgacgttgcctctcggcggcgcggcggcggtggacgagtacctggagtaccggaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgcctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 132576 - DNA, 761 bp, Homo sapiens
  Payload ID: 5893
  Gene Symbol: FAM221A
  Gene Name: family with sequence similarity 221, member A
  ENST ID: ENST00000409653
  CDS Start-End: 36-758
ggtccgcagggaagcctttggcttccccaccggcaatggagcggttgacgttgcctctcggcggcgcggcggcggtggacgagtacctggagtaccggaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaaga

SEQ ID NO: 132577 - DNA, 888 bp, Homo sapiens
  Payload ID: 5893
  Gene Symbol: FAM221A
  Gene Name: family with sequence similarity 221, member A
  Uniprot ID: A4D161
  ENST ID: ENST00000409192
  CDS Start-End: 90-878
ggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattgg

SEQ ID NO: 132578 - DNA, 571 bp, Homo sapiens
  Payload ID: 5893
  Gene Symbol: FAM221A
  Gene Name: family with sequence similarity 221, member A
  ENST ID: ENST00000446234
  CDS Start-End: 36-332
ggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacatagtagagacggagggtttcaccgtgttagccaggatggtctggatctcctgaccttgtgatctgcccgcctcagcctcccaaagtgctgggattacaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtg

SEQ ID NO: 132579 - DNA, 4090 bp, Homo sapiens
  Payload ID: 5893
  Gene Symbol: FAM221A
  Gene Name: family with sequence similarity 221, member A
  ENST ID: ENST00000429719
  CDS Start-End: 53-397
gggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacatagggtcttactctgtcactcaggttggagtgcagtggcacgatcttggctcattgcagcctcgacctcctgggctcaagcgatccttcgacctcagcctcccaagtagctgggaccacaggcgtctgccaccacatccagctaatttttgtatttttttgtagagaagtggtttggctttgttacccagactggtctggaactcctgggcttaagttatctgtctacctcgggctttccaaagtactcagattacacgtgtgcgccaccatgctcagctgacccaactcaactttgatggagaagttattatatttagtactgatccactcagtgagatttcttccaaactttttcaccccactattaaagtggtatatgattatcaaggaaaatgggggatatatagaaacatagaatatattctatatacaatatatagaagcagctcactacccaaagccagctgctagttttttttttttacaatatctgtatgactttttcttttttttttgagacggagtttcactcttgttgcccaggctggagtgcagtggcgcgacctcagctcactacaacctctgcctcgtgggttcaagcgattctcctgcctcagcctcctgagtagctgggattacaggcatgcaccaccatgccctgctaattttgtatttttagcagagacgggatttctccatgttggtcaggctgggctcgaactcccagcctcaggtgatccacctgccttggcctcccacagtgctgggattacaggcatgagccactgtgccatttaactgttgtgaagtatgtgtgtgcataaaatactgagccactttttaatgacagaatcatagaaatatgtttccacattgttatgtgctgatcaaaaacaagatttttaatacctgccagctagtccagctagtccagtggtgtttatctgtgttctccggagctgtgagggagccttgggggtgtgccaggtggaagggcaggttagaaggggaaactctattctgttcttcctttcgctttaaccaattctgcatttgttttatgtattctggttctataaaagattttatttgacaaaagggtttcactgctaaaatgtttgaaaactgttgtctagtaatttacttactggttctcttatgtcgtgtgggtgtgtgtataatgtagctgatgtaagtactattgctaatattattggtatgcataaagctttttctatatatggaattattttcttagggtatattttccaaaaatgaaatttctggttcaaagaatggaccttttcaagtttcttgaaacattattaaatagaatttgttcttttgtaacactcttttttttttttttttttttgagacagagcctcgcctgttgcccaggctggagtacagtggtgccatctcagctcactgcaacctctgcctcctgggttcaagggattctcctgcctcagcctcccgagtagctgggactacaggcatacaccaccatgctgggctaatttttgtatttttagtagagatggggttttcatcatgttgcccaggttggtcttgaactcctgagctcaagtgatccacctgccttggcctcccaaagtgctgggattacaggcatgtgccacaggctcctggccctttcgtaacactcttgatagcattgtgtattacatatagtttttaaaaactttgactctttttgctaagttaaaatggtatctcattttaatttgcatttcttttttttttcttttgagacggagtctttctctgttgcccaggctggagtgcagtggcgtgatctcggctcactgcaagctccgcctcccgggttcacaccattctcctgcttcagcctcccaagtagctgggactacaggtgcccaccaccacgctcggctaattttttgtatttttagtagagacggagggtttcaccgtgttagccaggatggtctggatctcctgaccttgtgatctgcccgcctcagcctcccaaagtgctgggattacaggtgtgagccaccgcaaccggcctttaatttgcatttctttgattaatattgagaataataaatttagtattattttactgaatatcacctatgagaagaaagtgagtgatctatttaagaaaattacaatactataagaaggagctttggctttcaaaaatattgataatttattttgaagtcaaaagtcatattaaaataaattacatcaacacatgtttattgaatatatttctattttaagtagcaaacatgcaaataaatttaagtaatgcactgtgacaaaaataacattggtaaagaactttttcttttcttttttttttttttgagatggagtttcgctcttgttgcccagggtggagtgcaatggtacgatctgggctcaccgcaacctctgcctcctgggttcaagcagttctcctgcctcagcctcctgagtagctggggttacaggcatgtgccacaacggccagctaattttttatttttagtagagacggggtttctctatattggtcaggctggtctcgaactcccgacctcaggtgatccgcccgcctcagcctcccaaagtgctgggattacaggcatgagccactgcgcccggcctgaactttttcatactcttaggctgtgcttctctattaaggaatctgtagaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtagatggatccttctgagagctgagcgggactggggagcagaatgtgttccctgtctacttgaaacacagtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgcctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaatttt

SEQ ID NO: 132580 - DNA, 1167 bp, Homo sapiens
  Payload ID: 5894
  Gene Symbol: FAM221B
  Gene Name: family with sequence similarity 221, member B
  ENST ID: ENST00000377984
  CDS Start-End: 264-1167
gctgaggcacatccacaaccaagagcctttcctccctgaggatcaacacctccccctgccatcctaagtcaaggtcttgacctaaggacttgtaacaaccaagccaaagcccagaggctacttgggaggctgaggcaggagaatcacttgaacccgggaggcggaggttgcagtgaaccgagattgcgccactgcactccagtctgggcaacagagcgagactccatcacaaaaagagaagagaagagaaggccagcaggcagatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacaggtctctacattggctggcgctgcccccattacctatgggactgtttccggattggggatgagtccagatgcttttgtggacacttgttgagagagcaccggatcatctcagacatatcggtgccctgcaaggtaagccagtgccgctgcttcatgttctgct

SEQ ID NO: 132581 - DNA, 3763 bp, Homo sapiens
  Payload ID: 5894
  Gene Symbol: FAM221B
  Gene Name: family with sequence similarity 221, member B
  Uniprot ID: A6H8Z2
  ENST ID: ENST00000388950
  CDS Start-End: 286-1308
ggttccggaggcttcagtcaagaccctccctcattggccctagaccccttgtccctacccacttccccaggtcatgccagagctcctttgcgaagttctgcagatatccaagtccccttcccagatagcagactttcaggcaaggcatttcaacactcagcacctgcagctgaggcacatccacaaccaagagcctttcctccctgaggatcaacacctccccctgccatcctaagtcaaggtcttgacctaaggacttgtaacaaccaagccaaagcccagaggatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacagacagaattcggaactcctctagtggaatcctggctcccgcccacctgcattgtgactgcctataccttgctctctcaacaaagcctccctggtgtaagggggcactggcactacaggcaatcagcatcaagacagaagaagcaaagccaaaagccacatctagacaggctttagatcctgacagactatgggtctctacattggctggcgctgcccccattacctatgggactgtttccggattggggatgagtccagatgcttttgtggacacttgttgagagagcaccggatcatctcagacatatcggtgccctgcaaggtaagccagtgccgctgcttcatgttctgctttatcccatcacgcccagaggaggtgggtgagttctggctcaagagacgggccacctttgaccccaaggcctggagggcccaatgtcgctgcaaacacagccacgaagaacatgcagccactgggccccatccctgcaggcatcatggctgttgctgcggctgttttgagtctaatttcctctgtgcggcctgtgaccggcgctgggaggaacacgagactttctttgacacccagaagacccggcaacgaggaggaaggcctcgcgggacagacactgtcagcaactggcacaggcctttgtgagtctggcccagatcagcaataaaagaggagtcattggaacctgacttggctctatatggggcaggtagatcccagcccagggagagactgcctaataacttagagttgacacctattagacacaggagaaagcctggatctggccatctgcctccatcacactcacattcaagctgcctgttgaaggaaagtggcttcaaggaagtcaagaagggaggaagtttcaagaaggatagagtgggaagtgatgttagatgcagttggggcaccaataagataaagactgaaaagtgtccattgggttttgcaattagaagatctttgggaacatcggagagtgcagtttcacactggtgcagtggaggcaggagtcaaacagcagtgagtttcaaggagtctcttaaagaagcttggatgaaaagtacaaaagtaaagtcagacaatatccagagggagttgtggagtcaaggaagtacttttgtaggaaggaaaaggggaagaggccagtagactaaaggaccttgaaggacccagaagagagagaagagatgcctggtgagacaagatcccagagatggaggaaagggatgaggtcaaagcagaggtgaagggattttctctggacaggagaaacaccacttcctatgaccaagacgaaggaagaggatggagccttcctagagtttcagggaacaagaacctgtggaagttcccctctgatggcttctatatgccctgtgaagtaggagataaggccaatggctggggtccaggggaagagggataagagtagggagcaggagacaagaagagaaaggggaaggtttgggaaggctaatgtagggaactggagaaaaacctcatcagtgggtagttcaggattcgggcacagttggaagtgagaacctagttagagaagcagagaatccaaatatttaatgggttgatgatgtgagggtgtcagggaggaagatcaggaaaactaagcaaaagaaggcatgaggatgtgaagggagcatacagcaccaatagggaaagaaagtgatgccaggaggcaaatgacagattgaaaaagggagcagtcaaaggaagagaagtctctaatgaggtacagtagcagacgtaggggcaggggttggagtacaagagacagtgttcagaggctgcagagcataacatctttcagatgagggcaagtgaaggtgataagtgcttgaagtagagaaaactgtgggccaaggatcaaaatcagtgaatgtgggaagtcacaagggagtccataggttcttatgggagtaggagattccagcactaatgggctctgtgaacccaggcaagtcactgtccctctttaggctgagtttctggacctgtaaaacaggaataacctctgtgttgcctactttctatgagaaccaaagaaataactaatttcaaagtgctttgtatccacctatcctccagactggcttccttcctcttcctagatcccagatccacttatctctcgcccttctccagggcaactctagggtctcccagtgtcccagaggcaccacagagaactgcagcctctggggcccagagaagaggccattctacatttcctcacaattaggggggccatctgttcctccaagggaaggaatgcaatctggactgctaggatccctggggaaaatcacagaatcaaatgtctgccctttagaggagaaaggattttctaacaataatatagctatacaaaagagattgttatatctctagaagcaaagttccccaacagtggttatatgccccatgataaccattcacctaaaactaattcaactaatagtcaacaatagagttaggattactatgataaactcattgaaggaaataataagcagccaatacaaactatatttacgtagactgtaaaaatatgaaaaattgattacacatgggttagtatcatatgcaatacatattacatattatgaaaaaaagacaggaaacaccaaatgttattcattcaacaattactgaccacctatatgtatcaggtcatgtgtttaaaaaaaaaaaaaagaaaa

SEQ ID NO: 132582 - DNA, 2931 bp, Homo sapiens
  Payload ID: 5894
  Gene Symbol: FAM221B
  Gene Name: family with sequence similarity 221, member B
  Uniprot ID: A6H8Z2
  ENST ID: ENST00000423537
  CDS Start-End: 271-1479
agtcaagaccctccctcattggccctagaccccttgtccctacccacttccccaggtcatgccagagctcctttgcgaagttctgcagatatccaagtccccttcccagatagcagactttcaggcaaggcatttcaacactcagcacctgcagctgaggcacatccacaaccaagagcctttcctccctgaggatcaacacctccccctgccatcctaagtcaaggtcttgacctaaggacttgtaacaaccaagccaaagcccagaggatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacaggtctctacattggctggcgctgcccccattacctatgggactgtttccggattggggatgagtccagatgcttttgtggacacttgttgagagagcaccggatcatctcagacatatcggtgccctgcaaggtaagccagtgccgctgcttcatgttctgctttatcccatcacgcccagaggaggtgggtgagttctggctcaagagacgggccacctttgaccccaaggcctggagggcccaatgtcgctgcaaacacagccacgaagaacatgcagccactgggccccatccctgcaggcatcatggctgttgctgcggctgttttgagtctaatttcctctgtgcggcctgtgaccggcgctgggaggaacacgagactttctttgacacccagaagacccggcaacgaggaggaaggcctcgcgggacagacactgtcagcaactggcacaggcctttgtgagtctggcccagatcagcaataaaagaggagtcattggaacctgacttggctctatatggggcaggtagatcccagcccagggagagactgcctaataacttagagttgacacctattagacacaggagaaagcctggatctggccatctgcctccatcacactcacattcaagctgcctgttgaaggaaagtggcttcaaggaagtcaagaagggaggaagtttcaagaaggatagagtgggaagtgatgttagatgcagttggggcaccaataagataaagactgaaaagtgtccattgggttttgcaattagaagatctttgggaacatcggagagtgcagtttcacactggtgcagtggaggcaggagtcaaacagcagtgagtttcaaggagtctcttaaagaagcttggatgaaaagtacaaaagtaaagtcagacaatatccagagggagttgtggagtcaaggaagtacttttgtaggaaggaaaaggggaagaggccagtagactaaaggaccttgaaggacccagaagagagagaagagatgcctggtgagacaagatcccagagatggaggaaagggatgaggtcaaagcagaggtgaagggattttctctggacaggagaaacaccacttcctatgaccaagacgaaggaagaggatggagccttcctagagtttcagggaacaagaacctgtggaagttcccctctgatggcttctatatgccctgtgaagtaggagataaggccaatggctggggtccaggggaagagggataagagtagggagcaggagacaagaagagaaaggggaaggtttgggaaggctaatgtagggaactggagaaaaacctcatcagtgggtagttcaggattcgggcacagttggaagtgagaacctagttagagaagcagagaatccaaatatttaatgggttgatgatgtgagggtgtcagggaggaagatcaggaaaactaagcaaaagaaggcatgaggatgtgaagggagcatacagcaccaatagggaaagaaagtgatgccaggaggcaaatgacagattgaaaaagggagcagtcaaaggaagagaagtctctaatgaggtacagtagcagacgtaggggcaggggttggagtacaagagacagtgttcagaggctgcagagcataacatctttcagatgagggcaagtgaaggtgataagtgcttgaagtagagaaaactgtgggccaaggatcaaaatcagtgaatgtgggaagtcacaagggagtccataggttcttatgggagtaggagattccagcactaatgggctctgtgaacccaggcaagtcactgtccctctttaggctgagtttctggacctgtaaaacaggaataacctctgtgttgcctactttctatgagaaccaaagaaataactaatttcaaagtgctttgtatcca

SEQ ID NO: 132583 - DNA, 719 bp, Homo sapiens
  Payload ID: 5894
  Gene Symbol: FAM221B
  Gene Name: family with sequence similarity 221, member B
  ENST ID: ENST00000472182
  CDS Start-End: 449-719
agtcaagaccctccctcattggccctagaccccttgtccctacccacttccccaggtcatgccagagctcctttgcgaagttctgcagatatccaagtccccttcccagatagcagactttcaggcaaggcatttcaacactcagcacctgcagctgaggcacatccacaaccaagagcctttcctccctgaggatcaacacctccccctgccatcctaagtcaaggtcttgacctaaggacttgtaacaaccaagccaaagcccagaggccgggcatggtggcacacgcctgtaattccagctacttgggaggctgaggcaggagaatcacttgaacccgggaggcggaggttgcagtgaaccgagattgcgccactgcactccagtctgggcaacagagcgagactccatcacaaaaagagaagagaagagaaggccagcaggcagatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatg

SEQ ID NO: 132584 - DNA, 2731 bp, Homo sapiens
  Payload ID: 5895
  Gene Symbol: FAM222A
  Gene Name: family with sequence similarity 222, member A
  Uniprot ID: Q5U5X8
  ENST ID: ENST00000358906
  CDS Start-End: 167-1525
actttctaaatcacagtgcctgtggccggatgacatggagggagctccctgaccataggaggggttagagacacgacgcccctctaccctcactcacagcagaggtggaaagctggagactgacccacacatggagcgcaccccactggggacccccagctcagccatgctggcctgtctgcagaggacccagaacgccccgggccaacacctggcctgcccgagcaagagcctggagctgcgcaagtgcgaggcggtggccagcgccatgcattcctcccgctacccgagcccagcagaactggacgcctatgccgagaaggtggccaacagcccgctgtccatcaagatcttccccaccaacatccgtgtgccccagcacaagcacctcagccgcacagtcaatggctatgacaccagtggccagcgctacagcccctacccacagcacaccgctggctaccagggccttctggccattgtcaaggccgcggtttcctcctccagcacggccgcaccagctgggcccgccaaaagtgtgctcaagagcgccgagggcaagcggaccaagctgtcaccggccgccgtgcaggtgggcattgcgccctacccagtgcccagcactctgggtcccttggcctaccccaagccacctgaggcgcctgctccaccacccggcctgcccgcagccgccactgccgcctccgtcatccccctgccgggccggggcctgcccctgccaccttccaacctgccctccatccacagcctcctgtaccagctcaaccagcagtgccaggccccgggcgccgcaccccctgcctgccagggcatggctattccccatcccagccctgccaagcacggcccagtgcccagcttccccagcatggcctactcggctgcagccggtctgcccgactgccggaaaggcactgagctgggccagggagccacccaagccttgacgttggctggggccgccaagcctgcagggtacgcagacagcggcctggattacctgctgtggccgcagaaaccgcccccaccgccgccccagccactgcgtgcctacagtgggagcacggtggccagcaagtcccctgaggcttgcgggggccgggcatacgagcgggccagcgggtcacccctcaactgtggcgtggggctgcccaccagcttcaccgtaggccagtactttgcggccccgtggaacagtgtgctggtgacacccaccagcgactgctacaacccagcggcggcggtggtggtcacggagctggggccgggggcagcccgggagctggctgggccccctgcagatgccctctcgggcctgcccagcaagagtgtgtgcaacacatcggtgctgagcagcagcctgcagtcactggagtatctcatcaacgacatccggccgccctgcatcaaggagcagatgctgggcaagggctatgagacggtggccgtgccccggctactcgaccaccagcatgcccacatccgcctacccgtctacagataaggcctgccctgcggacatacggacatgcggacagggcgcagagccgggaggcaggccgcagaacagggtgggcggctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacac

SEQ ID NO: 132585 - DNA, 3294 bp, Homo sapiens
  Payload ID: 5895
  Gene Symbol: FAM222A
  Gene Name: family with sequence similarity 222, member A
  Uniprot ID: Q5U5X8
  ENST ID: ENST00000538780
  CDS Start-End: 717-2075
cgctgttcgccggcttcccctccccccacacccggggctcagagcaggaggaggaggggccggtgcattctcgccgctgttctttgcaacctgcaggggccggtgtatgtccggcgaggagccggggccgctgcgggtgcgtgcaacccccgaaggagacaatccctccacctcggggcgaacccgggggctgcaagccgcgggcgggcgggcgagcgagaggaagcaacaaagacaggctgcagctggggctggcgaaaggggccgcggccgccgggctcccagcgcgggcggagagggcgccctgggagcggcgcgggccgagctgcagccttgagcggggccccgaggggaggcgcagcgccgcccgccggacgtggcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcgtcaggcagcctctgccactcctgcatggctgcgacccgtcgagcggagcgtcgtggtagctgagacctggtgcccttcgacggcctggctgatccgggacccagtcgcagagcgcaccccactggggacccccagctcagccatgctggcctgtctgcagaggacccagaacgccccgggccaacacctggcctgcccgagcaagagcctggagctgcgcaagtgcgaggcggtggccagcgccatgcattcctcccgctacccgagcccagcagaactggacgcctatgccgagaaggtggccaacagcccgctgtccatcaagatcttccccaccaacatccgtgtgccccagcacaagcacctcagccgcacagtcaatggctatgacaccagtggccagcgctacagcccctacccacagcacaccgctggctaccagggccttctggccattgtcaaggccgcggtttcctcctccagcacggccgcaccagctgggcccgccaaaagtgtgctcaagagcgccgagggcaagcggaccaagctgtcaccggccgccgtgcaggtgggcattgcgccctacccagtgcccagcactctgggtcccttggcctaccccaagccacctgaggcgcctgctccaccacccggcctgcccgcagccgccactgccgcctccgtcatccccctgccgggccggggcctgcccctgccaccttccaacctgccctccatccacagcctcctgtaccagctcaaccagcagtgccaggccccgggcgccgcaccccctgcctgccagggcatggctattccccatcccagccctgccaagcacggcccagtgcccagcttccccagcatggcctactcggctgcagccggtctgcccgactgccggaaaggcactgagctgggccagggagccacccaagccttgacgttggctggggccgccaagcctgcagggtacgcagacagcggcctggattacctgctgtggccgcagaaaccgcccccaccgccgccccagccactgcgtgcctacagtgggagcacggtggccagcaagtcccctgaggcttgcgggggccgggcatacgagcgggccagcgggtcacccctcaactgtggcgtggggctgcccaccagcttcaccgtaggccagtactttgcggccccgtggaacagtgtgctggtgacacccaccagcgactgctacaacccagcggcggcggtggtggtcacggagctggggccgggggcagcccgggagctggctgggccccctgcagatgccctctcgggcctgcccagcaagagtgtgtgcaacacatcggtgctgagcagcagcctgcagtcactggagtatctcatcaacgacatccggccgccctgcatcaaggagcagatgctgggcaagggctatgagacggtggccgtgccccggctactcgaccaccagcatgcccacatccgcctacccgtctacagataaggcctgccctgcggacatacggacatgcggacagggcgcagagccgggaggcaggccgcagaacagggtgggcggctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacacagatggtgtctca

SEQ ID NO: 132586 - DNA, 4033 bp, Homo sapiens
  Payload ID: 5896
  Gene Symbol: FAM222B
  Gene Name: family with sequence similarity 222, member B
  ENST ID: ENST00000341217
  CDS Start-End: 437-1741
tcttccttgctgtttcctctagcctagagttgtgaggtcacaattgcaagtgactttacggtcccctattgagttaaagatggagaagaaaaaggcctttgagcaatggctaaacattattcagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcgc

SEQ ID NO: 132587 - DNA, 2836 bp, Homo sapiens
  Payload ID: 5896
  Gene Symbol: FAM222B
  Gene Name: family with sequence similarity 222, member B
  Uniprot ID: Q8WU58
  ENST ID: ENST00000452648
  CDS Start-End: 268-1956
agccggctgggggagggggtgtcggcgcaccgcggagtcctgcgctccgtgagcctggcacccggagcagccgcctccccctccccctgcctagaccgctagaagccccctctcttccatcctcccggggcgggggtgagctgggctcagctgcccaaggcgggcggggcggagccaggagccccacggagcgctgcggagcgaacctcacctttccagggcgcaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacacc

SEQ ID NO: 132588 - DNA, 561 bp, Homo sapiens
  Payload ID: 5896
  Gene Symbol: FAM222B
  Gene Name: family with sequence similarity 222, member B
  ENST ID: ENST00000582059
  CDS Start-End: 108-194
ctttccagggcgcaaggtgtgtgtgtgctttttctaacgcgaccccgacttcagccgacttaacctttgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagag

SEQ ID NO: 132589 - DNA, 4161 bp, Homo sapiens
  Payload ID: 5896
  Gene Symbol: FAM222B
  Gene Name: family with sequence similarity 222, member B
  Uniprot ID: Q8WU58
  ENST ID: ENST00000581407
  CDS Start-End: 183-1871
acacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctc

SEQ ID NO: 132590 - DNA, 2613 bp, Homo sapiens
  Payload ID: 5896
  Gene Symbol: FAM222B
  Gene Name: family with sequence similarity 222, member B
  ENST ID: ENST00000582266
  CDS Start-End: 144-230
cacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaa

SEQ ID NO: 132591 - DNA, 556 bp, Homo sapiens
  Payload ID: 5896
  Gene Symbol: FAM222B
  Gene Name: family with sequence similarity 222, member B
  ENST ID: ENST00000583522
  CDS Start-End: 281-367
aaagggcccaggcgctacacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccaggaatatcacaggagtgatgctgtgttcttcactgcatgatttcaaaagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatga

SEQ ID NO: 132592 - DNA, 556 bp, Homo sapiens
  Payload ID: 5896
  Gene Symbol: FAM222B
  Gene Name: family with sequence similarity 222, member B
  ENST ID: ENST00000581381
  CDS Start-End: 302-388
gtagtccccacagctgcgccggtgactgaggggccgggcagtggagaagtggtggcggcgggcggcgggcggcaaaggagcagccatgagggccgggcccagtcaccgaccgaatatcacaggagtgatgctgtgttcttcactgcatgatttcaaaagcctagagttgtgaggtcacaattgcaagtgactttacggtcccctattgagttaaagatggagaagaaaaaggcctttgagcaatggctaaacattattcagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggt

SEQ ID NO: 132593 - DNA, 549 bp, Homo sapiens
  Payload ID: 5896
  Gene Symbol: FAM222B
  Gene Name: family with sequence similarity 222, member B
  ENST ID: ENST00000577682
  CDS Start-End: 184-270
agtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagc

SEQ ID NO: 132594 - DNA, 886 bp, Homo sapiens
  Payload ID: 5896
  Gene Symbol: FAM222B
  Gene Name: family with sequence similarity 222, member B
  ENST ID: ENST00000583307
  CDS Start-End: 169-886
cgggcggcaaaggagcagccatgagggccgggcccagtcaccgaccgtgctgaggagtcatggaagagtttttaaaccaggaatatcacaggagtgatgctgtgttcttcactgcatgatttcaaaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccc

SEQ ID NO: 132595 - DNA, 731 bp, Homo sapiens
  Payload ID: 5896
  Gene Symbol: FAM222B
  Gene Name: family with sequence similarity 222, member B
  ENST ID: ENST00000577513
  CDS Start-End: 324-731
ctggccattactgcgagaagccgaggccaagcggggaccagagaaagcggaccccgcgacgcaggacacgcacctccgttggaagcctaagagtgaggaaaaagggatcacccgctccctcgcgacatgagggcccacctgccagactcttaacaccgattgaacaagcctagccccgcgccagctgggggcagccattacagccgcaaggcactgcgggaaccgaccaggagcgctcctacgattgaacagagcggctgacgaaccagcgagtaggagagagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctat

SEQ ID NO: 132596 - DNA, 564 bp, Homo sapiens
  Payload ID: 5896
  Gene Symbol: FAM222B
  Gene Name: family with sequence similarity 222, member B
  ENST ID: ENST00000583953
  CDS Start-End: 116-202
gattgaacagagcggctgacgaaccagcgagtaggagagaggtgctgaggagtcatggaagagtttttaaaccagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccct

SEQ ID NO: 132597 - DNA, 568 bp, Homo sapiens
  Payload ID: 5896
  Gene Symbol: FAM222B
  Gene Name: family with sequence similarity 222, member B
  ENST ID: ENST00000584059
  CDS Start-End: 438-568
catataatgtgctgcttctgaaaatgtctggctggtctccaaccaggcctataaatgggctggctgagccaggccctatgagggcccactctcctcaggaatactgagacattataaatgcacctgtactttccagttgtatgaataggtgctttccagttttatttctcccatccatacatctgtggtaactgaaaaatcattttaaccatagtgatatttgacagcaaattgtcgtcacagataaagatgtaagtatactttcaaccaacacactgctaattaaattgctttatgtgtctaaacttgggcctcacgccagtcatatccagtgttcctactctcttcttcgaatgagttgccttgtgtttcatgaccttgtttttgttcattacagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccga

SEQ ID NO: 132598 - DNA, 462 bp, Homo sapiens
  Payload ID: 5896
  Gene Symbol: FAM222B
  Gene Name: family with sequence similarity 222, member B
  ENST ID: ENST00000579381
  CDS Start-End: 183-347
acacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatccctcttcaccatttcagcatcagtggaggcaggacaaagaaaactaatcaatgtggataagtgtccccttccatactcctgaatgaggtcaagcttcccccttgcctctgctaaaaaaaacctcagagttggtactaacttggaacaaagggactcttctactcatcaaggggacactacacagaaaatgagaactg

SEQ ID NO: 132599 - DNA, 598 bp, Homo sapiens
  Payload ID: 5896
  Gene Symbol: FAM222B
  Gene Name: family with sequence similarity 222, member B
  ENST ID: ENST00000581229
  CDS Start-End: 191-598
acagctgcgccggtgactgaggggccgggcagtggagaagtggtggcggcgggcggcgggcggcaaaggagcagccatgagggccgggcccagtcaccgaccgaatatcacaggagtgatgctgtgttcttcactgcatgatttcaaaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctat

SEQ ID NO: 132600 - DNA, 720 bp, Homo sapiens
  Payload ID: 5896
  Gene Symbol: FAM222B
  Gene Name: family with sequence similarity 222, member B
  ENST ID: ENST00000577376
  CDS Start-End: 184-720
agtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccg

SEQ ID NO: 132601 - DNA, 2417 bp, Homo sapiens
  Payload ID: 5897
  Gene Symbol: FAM227A
  Gene Name: family with sequence similarity 227, member A
  ENST ID: ENST00000355830
  CDS Start-End: 297-2237
agagtagcaaaatgggcctctccccaactcccctcctcatcccccagcacaaggcaaagggcaccccttgctgtgagtttgggggcaccggctgtcgggggccgacccagaactttgcggggtcccctgagggacccgtggcgggaccggccccgggttcgtcaaattccgccgatgctttcaggaggctgattaaacaaacgacaagattggagtgggaaatgagaggctcttaaaagtggaagctttttgtttgtccatttacaagaaattggacaatgaatcacttcaggaagatggaggtcatcaacctcaccaccctacctatgataccagtggatgagcacctggctgtctcgcttgtcgcacggaatacaatggtgaagactgtgaggaaggagttagagaacaatccaccctcatgccttattggctccatgcaccaggtgaaccaaaagattgctgacataaatctgcgtaccgagccgtcggccaacagcctggcaattgagagatttgagttggagaagaaggctttaagagagaaaactcgcagcagtccagaagacaaagtcaagagacaaaggaaatctcagtattcctgcaaaggctccgaactcagacatgccagatcttctgttataaaaaggaaaacagcagataaaaatctgctggcagagctgtaccagtattccaacttcaacagctccaagccaaacaagcttccgaatggcgtggacttctgtgacatggtgggcaacgtggtccgggctgagagagactgccttagtggcaagcatttctgttcaggtagagaattagagaagtttctctcttcttcttctccaagagccatctggctggatagcttttggtggatatttcatgagaggtaccagccaaacaaggagctccagaataatctgtttgaccggatagcccagcactatgccttacttttgtttcgtgtacccaagtcccactctgaagaggcgctcttaaaaaggctgccatcacttctcagcaaagccgtgtacaccagcttctgttgctgctttccacagtcctggttcgacacgcacgaattcaagtctgacatctgtaacacaatgagcctgtggatttcaggtggcacctatcctagcccacagagctatgacagctgggactactcggaactagacccagagcgattccgcagagaagaattaatgttgtacagaagaagactgacaaaggggagagagttttctttgtttgctggtaagagagccttctcccagaagccagcccagagcaggaaattctaccaccctcagtcttctagtgcaaattcacccagtgaaaaaacctcttcggccaagcagaactcagaaaaaagcttacgaatgcagaatactgcaaaagagcatcattgtcagaccctggtcttgaagaaacctacgcaagaagtcaagaggatatcagaagcaagagaatgtgagaatatgtttcctaaaaagtcgtgtgctgcctgcaaaagccctgagctgacttcaaacctcttcaacatttatgggaagagccctctgattgtgtactttctccagaactatgccagtctgcagcagcacggcaagaatgtgttgatagtcagaagggaaaagaccacgagcacccctgactgcaccccaacgtatactgatgtcatcagcgagaccctgtgcagcatgaagaagcggaaagacaacctcaatcagttgtaccagcatcattggactgaatggaattattttgacaagcatctaaaggagctgcaagacaacttctccagggaaatgaagaatattgatccaaaagcagcagatacaaaaaaggcaaaccacatgttcatcccaccttcagccgtcaatgaggaatcacctgacaagaaaactaagggaagtctccaaagagaaattgagtttaagggttgttcgaacaaaaaccatgggaaaggtagaagtgtgaacatgaggggaaaggaggagagggaaagagaagagaaacagaagttgaacatttctttccactcacttccaagccctgaggagctccacaacctagaaccaggaagcgcctacagaatccgtgatatttctgctacgaggaccccgcttagacgtccctcatcttgggagccttccctaatataccaggagcaagtgttgctgaaaacccatactctcagcatggaagaagataaattcagatgttaaactagaagagatgaagttaaaatcctatagtcctgattttgaattgcttatgaattgatgatgaaatgtatgttttagaacatacagtttcctgaagaacaggagggatagctggagaggggataggagggaagctggaaggggttacaaagaggcccaaataaacttttgggggtgaca

SEQ ID NO: 132602 - DNA, 10322 bp, Homo sapiens
  Payload ID: 5897
  Gene Symbol: FAM227A
  Gene Name: family with sequence similarity 227, member A
  Uniprot ID: F5H4B4
  ENST ID: ENST00000535113
  CDS Start-End: 605-2317
ccgcccggcctctaccaccgaggaaaggggtaaccggcgcgggggttcccagcgccagcctgcgccaatccccagaaactccgtgaatcacctcgggatagcaaacggattatacaaaggcagtgtcttctggggtccttttcatgcctctaggaccaggacctgcattcaccctctccactgacacattggtctgggcccccggcccggctgtcaccatagaaacggcatctcgcggacaacgcggcggctcacgaaggttccattgttatgctaaacgggaaagtggagaccgcgccggcgttgcctagagaacgcctggactcagagtagcaaaatgggcctctccccaactcccctcctcatcccccagcacaaggcaaagggcaccccttgctgtgagtttgggggcaccggctgtcgggggccgacccagaactttgcggggtcccctgagggacccgtggcgggaccggccccgggttcgtcaaattccgccgatgctttcaggaggctgattaaacaaacgacaagattggagtgggaaatgagaggctcttaaaagtggaagctttttgtttgtccatttacaagaaattggacaatgaatcacttcaggaagatggaggtcatcaacctcaccaccctacctatgataccagtggatgagcacctggctgtctcgcttgtcgcacggaatacaatggtgaagactgtgaggaaggagttagagaacaatccaccctcatgccttattggctccatgcaccaggtgaaccaaaagattgctgacataaatctgcgtaccgagccgtcggccaacagcctggcaattgagagatttgagttggagaagaaggctttaagagagaaaactcgcagcagtccagaagacaaagtcaagagacaaaggaaatctcagtattcctgcaaaggctccgaactcagacatgccagatcttctgttataaaaaggaaaacagcagataaaaatctgctggcagagctgtaccagtattccaacttcaacagctccaagccaaacaagcttccgaatggcgtggacttctgtgacatggtgggcaacgtggtccgggctgagagagactgccttagtggcaagcatttctgttcaggtagagaattagagaagtttctctcttcttcttctccaagagccatctggctggatagcttttggtggatatttcatgagaggtaccagccaaacaaggagctccagaataatctgtttgaccggatagcccagcactatgccttacttttgtttcgtgtacccaagtcccactctgaagaggcgctcttaaaaaggctgccatcacttctcagcaaagccgtgtacaccagcttctgttgctgctttccacagtcctggttcgacacgcacgaattcaagtctgacatctgtaacacaatgagcctgtggatttcaggcacctatcctagcccacagagctatgacagctgggactactcggaactagacccagagcgattccgcagagaagaattaatgttgtacagaagaagactgacaaaggggagagagttttctttgtttgctggtaagagagccttctcccagaagccagcccagagcaggaaattctaccaccctcagtcttctagtgcaaattcacccagtgaaaaaacctcttcggccaagcagaactcagaaaaaagcttacgaatgcagaatactgcaaaagagcatcattgtcagaccctggtcttgaagaaacctacgcaagaagtcaagaggatatcagaagcaagagaatgtgagaatatgtttcctaaaaagtcgtgtgctgcctgcaaaagccctgagctgacttcaaacctcttcaacatttatgggaagagccctctgattgtgtactttctccagaactatgccagtctgcagcagcacggcaagaatgtgttgatagtcagaagggaaaagaccacgagcaccccagactgcaccccaacgtatactgatgtcatcagcgagaccctgtgcagcatgaagaagcggaaagacaacctcaatcagttgtaccagcatcattggactgaatggaattattttgacaagcatctaaaggagctgcaagacaacttctccagggaaatgaagaatattgatccaaaagcagcagatacaaaaaaggcaaaccacatgttcatcccaccttcagccgtcaatgaggaatcacctgacaagaaaactaaggaggggaaaggaggagagggaaagagaagagaaacagaagttgaacatttctttccactcacttccaagccctgaggagctccacaacctagaaccaggaagcgcctacagaatccgtgatatttctgctacgaggtggagtggaacaagaaaataagaaaattgtggccaaagacagaaataggaatcatgatttctccataggggaaggattccgttgtagtttttcctaggctgagtgaaaagcaggagtagagagttggtgcttgggtcactacatttattcatagatttactctttcagtattttattacgtgcatgctggtaagtatgttacaaatatgacctcatacaaaggtaaaactttcataccagccgtatgaagtagggattatccactgcattttacgcagcagcaagcccaggtttagaaaggtttccgaagttctctgctgtagacactgggtaattaacagtagataagacacagtccctgttctcaagggagtcaccatctggtagagggaagacagatgtatcaacacattaaatgctgtaagtattggacagaggaaaaagagaaaagtgttgtgagggaaaaggaaaatgggcctagaggagtgcaattttttgtaacaagctttgtggaactattaatttgataatttgataggcgcttctattatgctgcctctgaacctttgcctcctgctcctctaaccactgggattgccagcctatttccaatatgccctctttctgcctggcaaacatcttgtcttttctaaactcagcccagggacatgacatctgtaatgtgtttctgtgtgactcccaggcttctgccttcttaacctctcaccttccagctcatttgagtgaatctttgtccaagaattgagagaaactttataggtaaagcatgcacatgttgtctgatttaatctaaaatagaaataagaaaacaaaaaataatactgcaactagggacacatttagtcactcccagttcatgagacaaggaatagtaaagttcattcctaccatagcaaaagtcaggatttaaatgtaaattaatttttttaattaaaaaattttaaattaggccaggcgtggtggctcacacctgtaatcccagcactttgggaggctgaagtgggcagatcacgaggtcaggagttcgagaccatcctggccaacatggtgaaaccccatctctactaaaaatacaaaaattagctggatgttgtggcgggcacctgtaatcccagctactcgggaggctgaggcagaagaatcgttggaacccaggtggcggaggttgcagtgagccaagaccatgctattgcactccagcctgggcaacaagagcgaaactctgtctcaaaaaaaaattttttttaattaattttaactaaattaaattttttagaggcagactctcagtctgttgtccaggctggaatgcagtggcgcagtcatagctcactgcaacctcaaattcctgggctgaagcaatcctcccacctcagcctcccaagtagctaggactacaggtatgccaccatgtctggctaatttttaaagaaatttttttgtagagatgggatctcactgtgttgcccaggctggtctcgaactcctggcttcaagtaatcctcctgccttgtccttccaaagcactgggattctaagtgtgagccaccacacctggcctggagtatctaatattgtataacataataatagtaatcataggtgatgtcatttattgagtacttagtatgtgctgagtgctctgctaagtctggtttagacattatctcagttaaccttcctggtgtcccccaagatggatattgttacctccattttctcctaggaagaaacggacttgggggggatgattaggtatttgctagatgtctattctgtaccatccctgcactaggccctgtgaatacagagataaataaagacacagtccctgaccttatggggctcacaatctggaaaaaagagaaggatgtgtaaaccaataaatgcattaatgctccgatagaaagctgcgtggaatctgagaaaaaccaaggcagatgaagccagtgtgccagcagccctttgggacagaagatatttcactgaggggcacaggcacaggggttggtttgccaaaggaccagcagctgggctgaagggcataggttttatcatttgagcttcaaggcacaaggcagtgacctggtctgtgctagaacagttcacctgtcacagccaagaggaaagaaatggtgcagatggctgtttgcccaaaccaagcagcagataagcagatcttgggaaatgtagctcatccctcagacacacatctttacttgaatcctgagtagaactctaggtgacccccttggaggctattactcatgtaaaaggggatgaaggaaaggtaagagagaaggagcttaggctttggcatgagaaaatttgggcctttgaatccctgccctgcttcaccatatggatgtgtgactcagcatagtagctgtgcatcttgacctttctgaacgtgctttcttgactgcagaaagggaatgcctgcctaggagggttgttgtgaggattagatgagataatttgtgcaaagttcttggcacagtacttttcactttgtaattgccacaagctgttattgttgttattgctgttataaagtgtactcttcttggccgggtgcagtggctcatgcctgtaatcccagcactttgggaggccaaggcaggtggatcgcctgaggtcaggagtttgagaccagcctggccaacgtggcgaaactccatctctactaaaaatacaaaaaaattagccgggcacaatggcaggtgcctgtaacctcagctactcaggaggctgaggcaggagaatcacttgaacccgggaggtggaggatgcagtgagctgagattgcaccattgcactccagcctgggtaacaagagtgaaactccatctcaaaaaaaaaaaaaaaaaagtatagtcttctgaaaccagaacgtgtgagcacctgccgagtacaaggcaccatgtggggcagataagcagaacactctctcaccttccctttactaccccagccactgtcaactcttcatttgcagtttctctaggaaccacactttcctatttctggatcttttgtctgttgctgcttctggacctgaaaatgccttctcctccctcctctttgttaactgccaacatcactaattcctgctcttcctccaggaccccgcttagacgtccctcatcttgggagccttccctaatataccaggagcaaggtaggcacaagtgctccactgcattatgctccaacagcattctgtgccatcccattatggcagcagttaccatagtagattggaattgcctgtctacctatccaccgctactattagcccccatacagcaagaaggtctccttattttctaagcccaggacaaactgcatttctgtctgtcaggaccatttgttgcacagtccaagatcatccctgcatggaccctttccagaaatgactgaggactcagagttgtagcctctcaggatgttaaatatgaagaaacctgtctctgccctttgtaaacattagaagggaaaattatggggaagaattatttgccctttataagggaagcggggtagagcatcaaagggaactaacatttaaaaagcatttgctgtaatgtgggataaagcaaatgagtaattgtatgatattctaattctgtcattcccagtgttgctgaaaacccatactctcagcatggaagaagataaattcagatgttaaactagaagagatgaagttaaaatcctatagtcctgattttgaattgcttatgaattgatgatgaaatgtatgttttagaacatacagtttcctgaagaacaggagggatagctggagaggggataggagggaagctggaaggggttacaaagaggcccaaataaacttttgggggtgacagatatgtctactatcttgattgtggtgaatggctcatgggtgtatacacacctaaatacactttaaatgtgtgcagtttctcatatgtcaattatacttcgataaagctttgttaaaaaacgaacaggccaggcatggtggctcacacctgtaatcccagcactttggaaggccaaggcaagaggattgcttgaggccaggagtttgagaccaaacaggacaacatagtgagaccttgcctctacaaaaacataaaaaattagtccgatgtggtagtgcatacctatagtcctagctactagggaggctgaggtgggaggatcgcttgagcctgggagcttaaggctgccatgagctgtgattgtgctactagactcagcctggatgatagagcaagactgtgtctgggaaaaaaaaaaaaaaaaacctgagccaggtgcggtggctaacgcctgtaatctcagcactttgggaggccgaggcgggtggattgcctgagaccagtagtttgagaccagcctgaccaacatggcgaaatcctgtctctactcaaaatgcaaaattagccgggtgtggtggcagctgcctgtagtcccgggtactcgcaaggctgaggcaggagaattgcttgaacccaggaagcggaggttacagtgagccaagatcatgccactgcactccagcctggacaacacagtgagactctgtctcaaaaatatgtgtatatatttcctaaaactctgtccactgaaatgacctagaaataaagactgacccggcagcagtgacccagactgtggtcttgaaatactatttgccctaaaaggatctagggatccttgaagaaatgatcagttccaggtctagggcaggaaaatcatgagacctgaaacatcttatcacacttaacaccaaggaagctatcaaagacaaggatcctgtcagaaagacttgggagcaaacttagagacaatcccattagctaaaagagaggaccatttgggcattaataataattgccatatttgaagcacgtcaaacgtgttctcacctgtaagttcatattgtgacttttaaaaaacggattggtgtctggacgcggtggctcacgcctgtaatcccagcactttgggaggccgaggtgggcagatcacctgaggtcaggagtttgagaccagcctggccaacaaggcaaaatcccgtctctactaaaaatacaaaaatcagccaggcgtggtggtgcatgcctggaatcctagctattcgggaggccgagacacaagaatcacttgaacttgggaggcggaggttacagtgagctgagatcgcaccactgcactccagcctaggtgatggagtgagactgtctcaaagataaaaaaggaaaggggaaaggaggaaactaattggatactaggaaacttcctcattattttgaaaattggtaagtaaatgaataagcatttatcatgccattcccatatgaactgtattaccaggtaaccaaatagtagtggaacagaaacttgtctttagaaacaatccacctaataaattcagaaataatgatagacttaaaatatcaccattttgaaacccctaatgaattaatggatctaggttgattatccatggctgcttacatcacaaaagacaaacagctattaaatgccttttgatactagaccataagaccacctatcaaatagtcttacaaataagtaaacttgaatgtgatctgaactctagatccaaccaccataacaggaaatacagaggatggggacatcatggcaaatggtaaatgacacctaggggatgcaatcagcaaaatccaggccatggaaaactccagggcaaatgacttcatttttttcaacaaataagtttcaagggaaaaagagagggggaatatatagattaaaagagacttaaaagaggacatcggttgccgagcatggtggcccatgcctgtaatcccagcactttaggaggccaaggtggaagaacccctagagcccaggaggtgagaccaaaccgggtaacatagtgagaccttgtctctacaaaaaaagtaaaaattagcagagcaaggtggcatacgcctgtagtcctagctacttgggaggctgacgtgggagaattgcttaagcctgggagttggagggtgcagtgagctatgatcatgccactgcacactccagcctaggtgacagaatgagaccacatctctaaaaagaaaaaaaaaagacatcaatcaattacaacatgtggacattatttggatcccattgaaacaaaatgtggcatttatgagacaaatggatatctgaatcttaaatattttatatataaaattattctaggcgtgataatagcattatggttatattttttaaagagttatcacattttagagatatatactgaaatattcacagatggaattacaagatttatggaatttgtactcaaataatatgggagagagaaagtggatggaggtataggtgaaacaagattgaccatgtgttgaaaattgttgaagatgggtgatgggaatattatactgttttacttttgtgcatatttgattttagccataatttttaaaattaaaggcatctaccatggacacttctaagcatattttacacactttcattgtggtctcactaaagccctgtgaatgaggtacaatttcccccattttcaaattgaggctcttcttgtttaaagcaccattactcctggcttgggacttctgttatacaatattctcctagcattctctttgccctttctcttgcccctccaatcagttctccacacaggagcccacatacttcatgtgtattaacccatttaattctcacaactcagcgccgatattattcttggttttcagataccgaaactcaggcacagagaggttaaataattttcccaagaccacacagctagtgaatggctgaagtgtgctctatgtctggcttagttgctgctcctatgtgtacttatgacaggaaaataaagtcaagatatgaatatacaagcctgccatatagtggtttagcatgtcagttaagagcatggtcactggagccagactgtgagcctcaggcaagttacttaacctcctggtgccccagttccatcgtgtaaataggggtgataattgttgtgcctcatggtgtctgtgtgaggagtggatgcatgaatctgtgggaggcacttagaacagtgcctgacacatggtaagtgcagcatgtactggctatcatgatcattattgggtgttcaacaaatactcgttccttttggcctctctcctttaattttgaaattaaaatcctccaccagaaccacttgcagttccccaaataagcctctgtgttccttctgcctttcccgccctgcccgattgacaaatcctcactgatccagccccaagctaagggccaccatccccgcaaccccagagagagcctctgcttggttcccagctgcatgtctaatccctctcatcctgccttgtgtggtgattatctctttctgcattgtcttctctactagactcatggctccttgagggcaggtacctacctgtctttatatccagcagagacgtggaattgagcagtgttgaataaatgctagtaaaataaactgtcatagcaagcctctcttggacacctatgtgctgaagttaaaaagtttttcaaatttggactgaaaaaatgagaaagcccaaaatgactattaaatatacatgtatgtgtgtgtatacatacacacagtcatgcaccacgtaacgatgtttcagtcagcagctgactgaatatatgacggtggtcccataagattataatggaactaaacaattcctatcacctagcgactcttagccttcgtaatgtcatagcgtaacgcattagtcacgtgtttgtggtgatgttggtgtgaacaaatgtactgtgttgcctgccagtcatataaaatatagtacacaatactggggtaatggtaataaatgactgttactggtt

SEQ ID NO: 132603 - DNA, 2008 bp, Homo sapiens
  Payload ID: 5898
  Gene Symbol: FAM227B
  Gene Name: family with sequence similarity 227, member B
  Uniprot ID: Q96M60
  ENST ID: ENST00000299338
  CDS Start-End: 305-1831
gcaacaggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcatttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgaaagagtttttaaaatctggaagactcattttctctcagaagcctccattgctcttttgcatgactccttttggtggtggtttctccataaatttaggcctgacagagaaaaccaagattgcttattcgatagaatttcagaaagttatgtgacacttttcatgagcatacctctaagtcgaaaggatgcattttttcagatatatcctgattgtttggcacaagccatatatgcaacgttccatgaagcatttccagaatcgagttacctctttaatgatgaatttaaagaagatctagggaataacatttttctttggtgttcaggtttaaaacctcaaaaaggcttttggatccactggaaactgaaagaactctccacaaccaccattcatggtagcaaaaaagcacctgcaaaatcagtaaaggaaagaattgcagacagtcaagaacatatatcaactagtatcgacttcaatattataaagattctgaacaacccaagagcatatacgttgcccatatccaaggaagaatcaagattatcaagactagcaacaaagtcgcactatagtagtactggtccagagtttaatcgtgttctcttcaattttggaggtcagagtccattgattttatattatcttaagatgcatgagctggctggtatttccaaagcacctaagaaaaccaagattaaactcactaagatattccaggaaccactacctgctccaacataccgtgatgttataaaggaggcaaaaagacaatttgcaaggaaccaaaaggattttaggatactccaagcaaaggctaccaagaaacctcatgaagtgaaacaggactttgagaagttcctacataaactgcgttccgaagctgaaattgagagagaatgtgtggcatcactatcgtcatcatcatcatcatcaccatcatcaacagacaactacaactttgaggaagaagaatactaagagaaaccagaaatgaactctattcaagaataatgcatacaattcagtggtatcagtttaattgtaacaatatatttaattcaagtccaatccatgtaatcagtattaagagtgtgttttaccattcatctttaaaatcttcaaatcaataaatctcagtaagttattcttaaaaga

SEQ ID NO: 132604 - DNA, 1139 bp, Homo sapiens
  Payload ID: 5898
  Gene Symbol: FAM227B
  Gene Name: family with sequence similarity 227, member B
  ENST ID: ENST00000558594
  CDS Start-End: 249-749
gcgttcgtccgggacccgcctcaagcctcgcagcctttcacccagtttcctcccgattcttgctgggacaacaaaattgggaagcggttctcgaaacatactgtcaaggcgtagttgcagaatttcaagaaagctgagaatggagtggtcaataaaggcttctttttcggacttggtttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgggggtgtggggaatggggcctcactctgtggcccaggctggagtgcagtggcgcaaccgtggctcactgcaacctctgcctcccagattcaagtgattctcctgcctcagcctcccaagtagctgtgattacagggttgcagcttcacaggattcaaagcaaatgaacttactcagctacccagacatttggatgctgaacaaatttatctttttattttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaaactctgtgttactgctttgggaccctgaggttgctagcgtacactggcttggcatgtaaccgtaac

SEQ ID NO: 132605 - DNA, 1596 bp, Homo sapiens
  Payload ID: 5898
  Gene Symbol: FAM227B
  Gene Name: family with sequence similarity 227, member B
  Uniprot ID: Q96M60
  ENST ID: ENST00000561064
  CDS Start-End: 372-1286
aacaggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcagtgagttgtgaagaaatgttgatcccagagaaaagtttgcattttgcccacctcaaagatattttgatttttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgaaagagtttttaaaatctggaagactcattttctctcagaagcctccattgctcttttgcatgactccttttggtggtggtttctccataaatttaggatatatcctgattgtttggcacaagccatatatgcaacgttccatgaagcatttccagaatcgagttacctctttaatgatgaatttaaagaagatctagggaataacatttttctttggtgttcaggtttaaaacctcaaaaaggcttttggatccactggaaactgaaagaactctccacaaccaccattcatggtagcaaaaaagcacctgcaaaatcagtaaaggaaagaattgcagacagtcaagaacatatatcaactagctgaaagtgagaagatctagattcttatttgtgttggaccactaatgaccagtatgacttcgggcaagttacctgctgttccagagtctcagctgctacatttgtaaaattggtgtattggtctaatgcctctatggtgctttacaattctgtgatctgtgacttatactcactactaatataaggaacagggcacctacttttaaaagctgttattctttaaaaaggaggaaatggtttcacattgattatcagtgtttgatttttgcctcaataagaatattggaacaataaatgttaatttagagatggaa

SEQ ID NO: 132606 - DNA, 792 bp, Homo sapiens
  Payload ID: 5898
  Gene Symbol: FAM227B
  Gene Name: family with sequence similarity 227, member B
  ENST ID: ENST00000559905
  CDS Start-End: 247-792
caaaattgggaagcggttctcgaaacatactgtcaaggcgtagttgcagtgagttgtgaagaaatgttgatcccagagaaaagtttgcattttgcccacctcaaagatattttgattgaatttcaagaaagctgagaatggagtggtcaataaaggcttctttttcggacttggtttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgat

SEQ ID NO: 132607 - DNA, 562 bp, Homo sapiens
  Payload ID: 5898
  Gene Symbol: FAM227B
  Gene Name: family with sequence similarity 227, member B
  ENST ID: ENST00000561116
  CDS Start-End: 68-211
tcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaa

SEQ ID NO: 132608 - DNA, 982 bp, Homo sapiens
  Payload ID: 5898
  Gene Symbol: FAM227B
  Gene Name: family with sequence similarity 227, member B
  ENST ID: ENST00000558579
  CDS Start-End: 1-404
taaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaaactctgtgttactgctttgggaccctgaggttgctagcgtacactggcttggcatgtaaccgtaacaggtgttttttccttcttgtctgttcctgctctgtcagctcaggatgttttagcctgctcatttttgatcctgaaataagttgtgagtgcccttcttcacaacccttctgggtgtttcttttgagtcttcaagtgtctgtgggaattttggggtagtatccctgtagggtaaccaaacagtgaaaaactgcaggtgttgggaggtaattagatcaatagccagtgaatacgagggctaaaatgagggtgggatggttacctggtaaaactggtcattttgccctctatttcagttttctgctctttgtgtttatgtacattacatatgttctttttcattaaaaagtattaaatccaa

SEQ ID NO: 132609 - DNA, 911 bp, Homo sapiens
  Payload ID: 5898
  Gene Symbol: FAM227B
  Gene Name: family with sequence similarity 227, member B
  ENST ID: ENST00000560246
  CDS Start-End: 252-788
cgggacccgcctcaagcctcgcagcctttcacccagtttcctcccgattcttgctgggacaacaaaattgggaagcggttctcgaaacatactgtcaaggcgtagttgcagtgagttgtgaagaaatgttgatcccagagaaaagtttgcattttgcccacctcaaagatattttgatttttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggggtgtggggaatggggcctcactctgtggcccaggctggagtgcagtggcgcaaccgtggctcactgcaacctctgcctcccagattcaagtgattctcctgcctcagcctcccaagtagctgtgattacagggttgcagcttcacaggattcaaagcaaatgaacttactcagctacccagacatttggatgctgaacaaatttatctttttattt

SEQ ID NO: 132610 - DNA, 1774 bp, Homo sapiens
  Payload ID: 5899
  Gene Symbol: FAM228A
  Gene Name: family with sequence similarity 228, member A
  Uniprot ID: Q86W67
  ENST ID: ENST00000295150
  CDS Start-End: 87-707
ggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaagaacaaagtgggtgaaagaaagggtctggtgagcagaggcctggggcggggctggcatgcagggctttgcagcacccacgagcagcacatactggttccagaatgagccaccgccacagccctccctgtcagacaggcacccaagggcggaggaggcatggcccaagaagaagggtgtgaagaggaggagggagaaatggcggtggcctcaggctcagcactgcagctctgacagggcccctcgggcggggaagccttgcatgaagaaactcagacaagtggtaaatgtgggacctggaccccactttccggagacatcctgtccttccgaggtgagggccaacctggccacaggggcttttccccctgagatttcttcagcgccttcgcccgggcctttgcccttctgccactttcctaccattttccacttactccatccaaactgcaccaaagatggtgttctccttagtccacacacaactggtgggaagtttttgaaatgaaatttataccaaaaaattagggcaagatgagattttttgatatttaaaaggtatttttatatgtaggaattttctgagtatggatttcttatccagagctcatggttcatttgacacagttttcagctcctggtctatttccccttccattctctccgccacgccctgtgccctgaggcctgaggcgcaggaccctcccagggaaggcctagggggcttggtgggccaccgctcagctcaggacctgacagcgtcactcccaccctcaccaccacacacacaggatgggggactgctgctgctttccagcctgtgagcctggataggtattttgtgacccagctcctgctcagtcccatcgctgtccccggtctctccagggagtaagggattctccgtctgtggtaagttacctgtgactcttcagcagtttcctctgagcataattatatctgagagcacagggagctcctcattccatgtatttttcaaatattcaagatgtacaacgtgatgatttgctataggtattcattgtgaaatgtttgccacagtcaagcttgttgacatacccaccagctcacatttactgttttcgtgtgtgtggtgagaatactcacaatctactctctgagcaaactgcaaatatatgttattagtaactgta

SEQ ID NO: 132611 - DNA, 809 bp, Homo sapiens
  Payload ID: 5899
  Gene Symbol: FAM228A
  Gene Name: family with sequence similarity 228, member A
  ENST ID: ENST00000456591
  CDS Start-End: 121-441
gggcccgcgggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacgagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaa

SEQ ID NO: 132612 - DNA, 630 bp, Homo sapiens
  Payload ID: 5899
  Gene Symbol: FAM228A
  Gene Name: family with sequence similarity 228, member A
  ENST ID: ENST00000432434
  CDS Start-End: 1-630
ctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaaga

SEQ ID NO: 132613 - DNA, 516 bp, Homo sapiens
  Payload ID: 5899
  Gene Symbol: FAM228A
  Gene Name: family with sequence similarity 228, member A
  ENST ID: ENST00000415196
  CDS Start-End: 1-411
ctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatca

SEQ ID NO: 132614 - DNA, 703 bp, Homo sapiens
  Payload ID: 5900
  Gene Symbol: FAM228B
  Gene Name: family with sequence similarity 228, member B
  ENST ID: ENST00000615135
  CDS Start-End: 200-424
ctctgaagccgtcatctggagtctgtagtgaaggcctcttgttagggaaactggatggttagtgttcaaaatccattttgcgtgtgtgcaaggacacaggtggtattaaacagaagagaaaatcagatgactgtgaaatgttcaatactaaataagatgatttttagtttttccaggggcattgttatttgtgaccacaatgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttggggctgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctcta

SEQ ID NO: 132615 - DNA, 1238 bp, Homo sapiens
  Payload ID: 5900
  Gene Symbol: FAM228B
  Gene Name: family with sequence similarity 228, member B
  ENST ID: ENST00000613899
  CDS Start-End: 378-941
gaggagggtggcgagaggtggggtggggcccaggtgagtagcgggcgaaggcggggcctgaggaggactgagctggggcgggacccagcagctgctccaagcttttctgccatttgaagcttcttctgggagccagctgtgaccagaggaatagctccagccatccggttaaaagtttaacaaccggaacagctccagtctgcagctcccagcgtgatcgacgcagaagacaggtgatttctgcatttccgactgaggttttagctaaagaagatactgaggcagctattcaatcaatattatacaaagaaaattctgtaattaagggaaatgcatttatagaacattatgatccaaaagagtatgatcccttttatatgagcaagaaggaccccaattttctgaaggttaccatcccaccatttcatgaccctttgaaaaaagcacaatatgacaaggataacgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacctttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttggggctgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctca

SEQ ID NO: 132616 - DNA, 1357 bp, Homo sapiens
  Payload ID: 5900
  Gene Symbol: FAM228B
  Gene Name: family with sequence similarity 228, member B
  ENST ID: ENST00000615575
  CDS Start-End: 87-1061
ggaacccgcggcgcagggggcggagtgctcgcgcggcgctgcgtccgggagacgtttttccaggggcattgttatttgtgaccacaatgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataacgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacctttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttggggctgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctc

SEQ ID NO: 132617 - DNA, 757 bp, Homo sapiens
  Payload ID: 5900
  Gene Symbol: FAM228B
  Gene Name: family with sequence similarity 228, member B
  ENST ID: ENST00000611917
  CDS Start-End: 1-327
tattcaataaaggaattcaaagaagttgagaaggttcagctgcattccagattcccacaaatttctaattcaaggcactttataactccaaacgagtggctgaaactgcctacaagatacatagaaagtgaattttgtagaaggagaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtcctctctgtgcagatgtgatcatccctccaactcctagtaccagcccctgtctgctctgaggctctgctgtcagtcccctacgtgatctccaaggatcctcaggtcccagatgggagccctccacggtctccctccccgcgtttggggctgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcact

SEQ ID NO: 132618 - DNA, 362 bp, Homo sapiens
  Payload ID: 5900
  Gene Symbol: FAM228B
  Gene Name: family with sequence similarity 228, member B
  ENST ID: ENST00000611138
  CDS Start-End: 1-117
ccaagtgccaaagaggccatctctgaagggtatttttcttccttgagcctcagccaggaacgggaggaagaccaggatgggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctc

SEQ ID NO: 132619 - DNA, 975 bp, Homo sapiens
  Payload ID: 5900
  Gene Symbol: FAM228B
  Gene Name: family with sequence similarity 228, member B
  ENST ID: ENST00000611127
  CDS Start-End: 1-975
atgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataacgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacctttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttggggctgctgaagctggagctataa

SEQ ID NO: 132620 - DNA, 362 bp, Homo sapiens
  Payload ID: 5901
  Gene Symbol: FAM229A
  Gene Name: family with sequence similarity 229, member A
  ENST ID: ENST00000428500
  CDS Start-End: 1-159
ttccccattgaggccggagactcccgtggccttgccgccgcccccgagtcccaggacagcccggaggcggtagcgacggagcacaacccggtcagcggcccctgtcgcgcgtcaatttccccaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaa

SEQ ID NO: 132621 - DNA, 699 bp, Homo sapiens
  Payload ID: 5901
  Gene Symbol: FAM229A
  Gene Name: family with sequence similarity 229, member A
  Uniprot ID: H3BQW9
  ENST ID: ENST00000432622
  CDS Start-End: 153-536
gcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagacctgcccggctccgcctggaccggagcgttctcccgcggccagggctccggcagctgcttctagcctgggaccggtctcaaccgccgggagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttcca

SEQ ID NO: 132622 - DNA, 2543 bp, Homo sapiens
  Payload ID: 5902
  Gene Symbol: FAM229B
  Gene Name: family with sequence similarity 229, member B
  Uniprot ID: Q4G0N7
  ENST ID: ENST00000368656
  CDS Start-End: 298-540
gccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaacagttgagctctttacttttagtaagaccgacagaaatgtagtcagtaaagcacatgtagtgataggctatcagttatgtctgatacataagacagaataatatttcacaattagaaagtaccttagagatcatcttgctcacagtagatcattaatatcaataattaaagatgaagcttaatccaccatggtcatcagtcaggtggggcttattctaaatgcttaatgtgtcttaagctcatttccttgttcatatttgggttgctacttggctaaatcctttcaccttagtaccctaagccagtttcctggcttgatactatttgataatgctctgctcaggaatgattatattgggtgagaaatggagccctggggttgtgtgttttggaacagtattcaagatcaaagaaagttcttagtccatggttaatctgcaaggcatttaagccacttccatagaggagcccagattgttggttaaatatattgataatgaagtcaaagctgtggttccaaccccgatttttccaagaaaaatgacgtctggttatcactttgtacacgaagtgctaaccaggtatcttgataaattgtttacagtaggtattgagaaacctcatgtggattttttaatttggttagatgtgggatcacttttgaggatgaggccagctctctatgttctctttttcttcttgcagtagtccccagaaactcagtctgctttccttttctctcgatggctgtcagcacccatctaatgaaattgtcttctccaaaagactgactttaggatcagatacaattttcaccagtgttttttgtctaccttgctgcttctgaaaatatacatataagccttttaaaatgaaaagtttattaacttataattaaatagacgtagatgcatatgtgttgcattaggtgaaaagaaaaactgccagggagttataagaggaaaaactctcagagctcacactgagctgggagaagtttgaatgccaaccagttaaagtggaaagatcttgaacatgtggggcattgagtagagactcagaaaggttgtactttcataagagatccaaactggagctagactaaaggctaatgtataccaattttaagaaagcttaaaaataagccttgagagactcaagatgatctctaagtaacctcattttatctgccaaataaaaatagaacattccttaaaggaagaaaacaaaatcgaggcaggaaattgcctgaggctggagaaaaaatgacaggaaggagaaaggagtgatgaaaaattcctcagagggctgggcttggtggctcatgcctgtaatcctggcactttgggaggccgaagtggatggattatctgaggtcaggcattcgaagccagcctggccaacatggtgaaaccccgactctactaaaaatacaaaaattagtcgggtatgatgggcaggtgcctgtaattccagctacttgggaggctgaggcaggaaaatagcttgaacccaggaggcagaggttgcagtgagctgagattgcatcactgtgctccagcctaggcaacagagtgagactttgtctcaaaaaaaaagaaaaacaaagaaaaattcctcagagctcatacaaggctgggtagaatatgtgtttcaacaatagtggatcttttaatatagtacatggatcattgagtagagtcttcagcaaaatattggcaaagtagggttagggttaggttagggagatgggaatagactgaagactactctggacttgccctaacagagtttaagagcaacatttgaaaggatcaaactgatttcaagtaacttgagtgcatccaaggggagaaaacccatcaaaataaaaataaaaactacaataaaatcca

SEQ ID NO: 132623 - DNA, 598 bp, Homo sapiens
  Payload ID: 5902
  Gene Symbol: FAM229B
  Gene Name: family with sequence similarity 229, member B
  Uniprot ID: Q4G0N7
  ENST ID: ENST00000604268
  CDS Start-End: 248-490
actgggcttctggactgtatatcctagctgccttgtcaacatcttcgagcatcggcagctccggaggccgggcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaa

SEQ ID NO: 132624 - DNA, 510 bp, Homo sapiens
  Payload ID: 5903
  Gene Symbol: FAM231A
  Gene Name: family with sequence similarity 231, member A
  Uniprot ID: P0DMU4
  ENST ID: ENST00000434336
  CDS Start-End: 1-510
atggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctga

SEQ ID NO: 132625 - DNA, 510 bp, Homo sapiens
  Payload ID: 5904
  Gene Symbol: FAM231B
  Gene Name: family with sequence similarity 231, member B
  Uniprot ID: A6NCW3
  ENST ID: ENST00000601199
  CDS Start-End: 1-510
atggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacagaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctga

SEQ ID NO: 132626 - DNA, 510 bp, Homo sapiens
  Payload ID: 5905
  Gene Symbol: FAM231C
  Gene Name: family with sequence similarity 231, member C
  Uniprot ID: P0DMU5
  ENST ID: ENST00000600179
  CDS Start-End: 1-510
atggggtgttcaaagggactgtggaaagagaggccttcagcccacacctctgaatgcttttcgaccacagcatgccctgtggcctttatcctgctggtgtggaacagtcagagccctgcagggctgcagagcttctgtactgggcggcatcccagcctgagtgtcagagctcagagagcaggcaccggagcaagtagagaggagggcaccttttggacagaatgtgtgggacaagagcgacggctcatccattcaggttcctcagaaaatgagagtcaggaagatgagggcgcagacctgattccctacacagggctgaaagcagacaaccggaggaagagcagcacctgggccaacgaggtagaagacagaagaccacagtctactcctgccctcaatctcaccccttcccacccacatcctccacgccccctgatcaccttcctcagaagtgtaataggaatccagattccccctggcctggttgctgcgggaggcacagtggcctga

SEQ ID NO: 132627 - DNA, 511 bp, Homo sapiens
  Payload ID: 5906
  Gene Symbol:
  Gene Name: family with sequence similarity 231, member C [Source:EntrezGene
  Acc:729587]
  Uniprot ID: P0DMU3
  ENST ID: ENST00000624031
  CDS Start-End: 1-510
atggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctgat

SEQ ID NO: 132628 - DNA, 3394 bp, Homo sapiens
  Payload ID: 5907
  Gene Symbol: FAM231D
  Gene Name: family with sequence similarity 231, member D
  Uniprot ID: Q6ZW35
  ENST ID: ENST00000607157
  CDS Start-End: 2176-2685
cttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagagacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctccccaagcactggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatccgttcaggttcctcacaaaatgagagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctcccagtctgtcagaatggccacttgcaggctgtaaccctttataaaaaaataaaatctcctttctaaatttataaa

SEQ ID NO: 132629 - DNA, 2901 bp, Homo sapiens
  Payload ID: 5908
  Gene Symbol: FAM234A
  Gene Name: family with sequence similarity 234, member A
  Uniprot ID: Q9H0X4
  ENST ID: ENST00000301678
  CDS Start-End: 145-1803
ccgcggcggcaggtccacctgggcttgcgaaggcacagattccccgtccacagctcacgaccagatgcaccagcaggagtccacatcgaggacgtcctccgggcactcccacgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagccta

SEQ ID NO: 132630 - DNA, 1936 bp, Homo sapiens
  Payload ID: 5908
  Gene Symbol: FAM234A
  Gene Name: family with sequence similarity 234, member A
  Uniprot ID: Q9H0X4
  ENST ID: ENST00000301679
  CDS Start-End: 196-1818
agtgacgccagggggcggggccagcggcgcggtcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtgg

SEQ ID NO: 132631 - DNA, 3213 bp, Homo sapiens
  Payload ID: 5908
  Gene Symbol: FAM234A
  Gene Name: family with sequence similarity 234, member A
  Uniprot ID: Q9H0X4
  ENST ID: ENST00000399932
  CDS Start-End: 452-2110
tcgggagaggaggaggaggggagcgaggacgcagagaaggaggggaaagaggacggagaggagcgaggacggaggggggacgggaacgaagaggggcgaggacgttcagcatccattgcgacagcgacaaacaggacaccgccaggttcccggcggaggcagcgcccaagatccccgttgccgagcaaccgaagcatggcggtggggcggggtcggagcctgcgcatttccgcccccgcccgcccggctggtcggaagtgacgccagggggcggggccagcggcgcggtcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 132632 - DNA, 583 bp, Homo sapiens
  Payload ID: 5908
  Gene Symbol: FAM234A
  Gene Name: family with sequence similarity 234, member A
  ENST ID: ENST00000419173
  CDS Start-End: 277-583
ggggccagcggcgcggtcgggtgagaggccgcggcggcaggtccacctgggcttgcgaaggcacagattccccgtccacagctcacgaccagatgcaccagcaggagtccacatcgaggacgtcctccgggcactcccacgaccagataaggaaactgaggcacagttcagtcaaagcacatgtcctggtcacacagctagggaggtgcaagcctgcccgcccagagcccatcttcactccggtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacgggg

SEQ ID NO: 132633 - DNA, 374 bp, Homo sapiens
  Payload ID: 5908
  Gene Symbol: FAM234A
  Gene Name: family with sequence similarity 234, member A
  ENST ID: ENST00000426695
  CDS Start-End: 223-374
ggcgcggtcgggtgagaggccgcggcggcaggtccacctgggcttgcgaaggcacagattccccgtccacagctcacgaccagatgcaccagcaggagtccacatcgaggacgtcctccgggcactcccacgaccagctttgtgccgtgggactgctggcctcgccgacctcttgctttatcgacacagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggc

SEQ ID NO: 132634 - DNA, 432 bp, Homo sapiens
  Payload ID: 5908
  Gene Symbol: FAM234A
  Gene Name: family with sequence similarity 234, member A
  ENST ID: ENST00000447499
  CDS Start-End: 172-432
gcggtcgggtgagaggccgcggcggcaggtccacctgggcttgcgaaggcacagattccccgtccacagctcacgaccagatgcaccagcaggagtccacatcgaggacgtcctccgggcactcccacgaccaggtagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagt

SEQ ID NO: 132635 - DNA, 1006 bp, Homo sapiens
  Payload ID: 5908
  Gene Symbol: FAM234A
  Gene Name: family with sequence similarity 234, member A
  ENST ID: ENST00000420046
  CDS Start-End: 308-1006
ggccgcggcggcagagatggtccgtgcatgggggaaatgtttgtcctttcggccaggctctccaattcaaaaggcaggaattgagaaaatgacagtactttctctgtccctgccacagaatgtccagtttggtctgatttaacatgacaaatcatgctgtagagataagtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggag

SEQ ID NO: 132636 - DNA, 984 bp, Homo sapiens
  Payload ID: 5908
  Gene Symbol: FAM234A
  Gene Name: family with sequence similarity 234, member A
  ENST ID: ENST00000453430
  CDS Start-End: 277-984
tcgggtgagaggccgcggcggcagcagaggtggggtttcaccatgttgttcaggctggtctcgaactcctgacttcgtgatctgcctgcctcggcctccgaaagtgctgggattacaggcgcaaaccaccacgcccggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggag

SEQ ID NO: 132637 - DNA, 554 bp, Homo sapiens
  Payload ID: 5908
  Gene Symbol: FAM234A
  Gene Name: family with sequence similarity 234, member A
  ENST ID: ENST00000438220
  CDS Start-End: 162-554
cgcggtcgggtgagaggccgcggcggcaggtccacctgggcttgcgaaggcacagattccccgtccacagctcacgaccagatgcaccagcaggagtccacatcgaggacgtcctccgggcactcccacgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaagctgctgtg

SEQ ID NO: 132638 - DNA, 583 bp, Homo sapiens
  Payload ID: 5908
  Gene Symbol: FAM234A
  Gene Name: family with sequence similarity 234, member A
  ENST ID: ENST00000417499
  CDS Start-End: 378-583
atttggggacaagcatttgggcacactcgctacaagattggttagtgattatggatgatgaagtctgtcggaaaattcagatcttgattgtccacctgggcttgcgaaggcacagattccccgtccacagctcacgaccagatgcaccagcaggagtccacatcgaggacgtcctccgggcactcccacgaccagataaggaaactgaggcacagttcagtcaaagcacatgtcctggtcacacagctagggaggtgcaagcctgcccgcccagagcccatcttcactccggctttgtgccgtgggactgctggcctcgccgacctcttgctttatcgacacagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgt

SEQ ID NO: 132639 - DNA, 887 bp, Homo sapiens
  Payload ID: 5908
  Gene Symbol: FAM234A
  Gene Name: family with sequence similarity 234, member A
  ENST ID: ENST00000449945
  CDS Start-End: 160-887
gtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcct

SEQ ID NO: 132640 - DNA, 646 bp, Homo sapiens
  Payload ID: 5908
  Gene Symbol: FAM234A
  Gene Name: family with sequence similarity 234, member A
  ENST ID: ENST00000424016
  CDS Start-End: 1-578
gggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacaggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggccc

SEQ ID NO: 132641 - DNA, 459 bp, Homo sapiens
  Payload ID: 5908
  Gene Symbol: FAM234A
  Gene Name: family with sequence similarity 234, member A
  ENST ID: ENST00000420500
  CDS Start-End: 151-459
cgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctggcttttcctctccctgcacctttgcagctgctgtgtcgggg

SEQ ID NO: 132642 - DNA, 739 bp, Homo sapiens
  Payload ID: 5908
  Gene Symbol: FAM234A
  Gene Name: family with sequence similarity 234, member A
  ENST ID: ENST00000421000
  CDS Start-End: 1-704
gtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggcagtccgatgtcacctgccatggggtagcagagaggaggagcggcttggcccccggctgctcctggggtgtcagtggtggcagtgcccagggcgagcccagaacatgaaccagcactcggcccgtcaggggagatcggggcctgtcagtgcccctaagcctgaaggtgcaggtctccgagccccagcggagccggcctcgtggaaggacgagggaaagaatgcgtggtgcacggggccatgtgtgtgtgtgggctccttgcacctcatcgcggtctggaagatttctgtgcctagatttggtgaatgttcatatttcccttacaagctgtcattttaaggatatggaggagaataaagagcaggctgaaaata

SEQ ID NO: 132643 - DNA, 4808 bp, Homo sapiens
  Payload ID: 5909
  Gene Symbol: FAM234B
  Gene Name: family with sequence similarity 234, member B
  Uniprot ID: A2RU67
  ENST ID: ENST00000197268
  CDS Start-End: 121-1989
ctcagctctgtccccagcaagcgggtcccacctttcccggtcccagccccacgcaccgccgctcggaactacacttcccggcagaacgcgggcgcgcgcacgcgcaccggggcctcagccatggcgaccgtgctgtccagggcgctcaagctgccggggaagaagagcccagacctaggggagtatgatccacttacccaggctgacagtgatgagagcgaagacgatctggtgcttaacctgcagaagaatggaggggtcaaaaatgggaagagtcctttgggagaagcgccagaacccgactcagatgctgaggttgcagaggctgcaaagccacatctttcagaagtcaccacggagggctacccctcagaaccccttgggggcctggaacagaaggcggcctcctccctggtgtcatatgtgcgcacgtctgtcttcctgctgactttggggatctcgatgatcctggtgctcctgtgtgctttcctgatcccctgtcctcccagagatctgcacagcacctggagccgccacttgggctcccagggaggtggggacctgtctccattggaattggctgatgtgaatggagatggcctgcgtgatgtgcttctctcctttgtgatgtcaaggaacgggagtgcagtaggtgtctcaagaccagctgctaatcttgtatgcctttcggggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagatttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggatcgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcagataatccacctgcttctgcctcccaaagtgctgggattacaggcgtgagccaccatgcccggctgggcttgtatcttttagcttgtgttagtaaaaggattctagaaaattatgaagtccagattcaaagggatctctgttaattacccactgacaggcattatgacctaacaggaggttggtagcagtagatccaagcatgcatgttgcctggcctgtagattggccttatcaggtttctgggtgcctctgccttaagatcctgaaggcaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaa

SEQ ID NO: 132644 - DNA, 2623 bp, Homo sapiens
  Payload ID: 5909
  Gene Symbol: FAM234B
  Gene Name: family with sequence similarity 234, member B
  Uniprot ID: A2RU67
  ENST ID: ENST00000416494
  CDS Start-End: 24-1892
gcacgcgcaccggggcctcagccatggcgaccgtgctgtccagggcgctcaagctgccggggaagaagagcccagacctaggggagtatgatccacttacccaggctgacagtgatgagagcgaagacgatctggtgcttaacctgcagaagaatggaggggtcaaaaatgggaagagtcctttgggagaagcgccagaacccgactcagatgctgaggttgcagaggctgcaaagccacatctttcagaagtcaccacggagggctacccctcagaaccccttgggggcctggaacagaaggcggcctcctccctggtgtcatatgtgcgcacgtctgtcttcctgctgactttggggatctcgatgatcctggtgctcctgtgtgctttcctgatcccctgtcctcccagagatctgcacagcacctggagccgccacttgggctcccagggaggtggggacctgtctccattggaattggctgatgtgaatggagatggcctgcgtgatgtgcttctctcctttgtgatgtcaaggaacgggagtgcagtaggtgtctcaagaccagctgctaatcttgtatgcctttcggggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagatttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggatcgtttggaaatgtgaatctcttaagtatttaatttttttgccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaa

SEQ ID NO: 132645 - DNA, 2011 bp, Homo sapiens
  Payload ID: 5909
  Gene Symbol: FAM234B
  Gene Name: family with sequence similarity 234, member B
  ENST ID: ENST00000537625
  CDS Start-End: 1-975
cttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagatttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagagggttaaaggccgaatttcttagccattcttgactgccacttgcaggacctcatcactccttggtctcctgttatgggtgatgcctccactaagttctggccgatgtgctgtaagcagaagtaacgtgtagcacttccaggaaatctctttataagacagttgtcagatgccagtttttttccccttccactgcattattactgccaggttcatagccattctgaggatttcagaaggctgatctctggagaactgaggggttcgaaagattgacttctcaggagcagggctgagaatggaatgggcccttaatacctgacagtttcccaagccctgatgacacaaagccagtgtaattaattcagaacataaggcttctgattccattactgactcatcatcagtagtggcagcagcagcagaagtcacttaagcttcttgtgatcatggcaccgtgatgggcatcttgcatgctcctgtctgctgacaatggcacatatctgcagtgacgtgggccgctttggaaagtgagtagcttgggttaggtgtcttcagagatggggttggatgacagtttgcaaaggctgtggtagaggtacgctgggtgaaacagcttccttcagattctgactatggtacagccagtgggaaacactggaatcattcaacttttcttccaacaaacatttcttgaacactaattgcgagcttggcactgtgctaggcccagaagatccccaggtaaatatcaccagttcctgcccttccgaagctcacagctgagaaaagggagacactccaaaaagccatccccggatgctgtgcagaggagtcacgtcgtgttcagactcagtccaaagtcagcacagaaaaggagatgacaaacagcccagaaaactcctccctcaaaaatcccataaatcgattctaaatagcttcctttgtttttagctagaacctccttttaaaaagttttttataaaaatgatgtataaggttgattttttagaggatggggaataaagagatctctttctctttc

SEQ ID NO: 132646 - DNA, 596 bp, Homo sapiens
  Payload ID: 5910
  Gene Symbol: FAM24A
  Gene Name: family with sequence similarity 24, member A
  Uniprot ID: A6NFZ4
  ENST ID: ENST00000368894
  CDS Start-End: 122-439
tccctctttctcagattacaggtttgagaagttccaaatatccgatgccctagaggtttttttcccttaattttattgttacaattggccttcatctagctctggatggttgaactgtagcatggcaaagatgtttgatctcaggacgaagatcatgatcggcatcggaagcagcttactggttgccgcgatggtgctcctaagtgttgtgttctgtctttacttcaaagtagctaaggcactaaaagctgcaaaggaccctgatgctgtggctgtaaaaaatcacaacccagacaaggtgtgttgggccacgaacagccaggccaaagccaccaccatggagtcttgtccatctctccagtgctgtgaaggttgtagaatgcatgccagttctgattccctgccaccttgctgttgtgacataaatgagggcctctgacttgggaaagctgggcacaaaaatcttcatgagcaatatttctttcttaatagaatgttttattattcaagtcaagttctagagtgtttacatactattatataatgtacagtgttattttctgtacttctgaataaatgtgcaatattggaaataa

SEQ ID NO: 132647 - DNA, 704 bp, Homo sapiens
  Payload ID: 5911
  Gene Symbol: FAM24B
  Gene Name: family with sequence similarity 24, member B
  Uniprot ID: Q8N5W8
  ENST ID: ENST00000368896
  CDS Start-End: 269-553
ggagaccatgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaat

SEQ ID NO: 132648 - DNA, 745 bp, Homo sapiens
  Payload ID: 5911
  Gene Symbol: FAM24B
  Gene Name: family with sequence similarity 24, member B
  Uniprot ID: Q8N5W8
  ENST ID: ENST00000368898
  CDS Start-End: 292-576
atgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaataatcctctttgctgccaa

SEQ ID NO: 132649 - DNA, 345 bp, Homo sapiens
  Payload ID: 5912
  Gene Symbol: FAM25A
  Gene Name: family with sequence similarity 25, member A
  Uniprot ID: B3EWG3
  ENST ID: ENST00000343959
  CDS Start-End: 20-289
cactgtctgctgccacacgatgctgggaggcctggggaagctggctgccgaaggcctggcccaccgcaccgagaaggccaccgagggagccattcatgccgtggaagaagtggtgaaggaggtggtgggacacgccaaggagactggagagaaagccattgctgaagccataaagaaagcccaagagtcaggggacaaaaagatgaaggaaatcactgagacagtgaccaacacagtcacaaatgccatcacccatgcagcagagagtctggacaaacttggacagtgagtgcacctgctaccacggcccttccccagtctcaataaaaagccatgacatgtgta

SEQ ID NO: 132650 - DNA, 319 bp, Homo sapiens
  Payload ID: 5913
  Gene Symbol: FAM25C
  Gene Name: family with sequence similarity 25, member C
  Uniprot ID: B3EWG5
  ENST ID: ENST00000617224
  CDS Start-End: 27-296
agttcgccactgtctgctgccacacgatgctgggaggcctggggaagctggctgccgagggcctggcccaccgcaccgagaaggccaccgagggagccattcatgccgtggaggaagtggtgaaggaggtggtgggacatgccaaggagactggagagaaagccattgctgaagccataaagaaagcccaggagtcaggggacaaaaagatgaaggaaatcaccgagacagtgaccaacacagtcacaaatgccatcacccatgcagcagaaagtctggacaaacttggacagtgagtgcacctgctaccacggccctt

SEQ ID NO: 132651 - DNA, 345 bp, Homo sapiens
  Payload ID: 5914
  Gene Symbol: FAM25G
  Gene Name: family with sequence similarity 25, member G
  Uniprot ID: B3EWG6
  ENST ID: ENST00000452267
  CDS Start-End: 20-289
cactgtctgctgccacacgatgctgggaggcctggggaagctggctgccgagggcctggcccaccgcaccgagaaggccaccgagggagccattcatgccgtggaggaagtggtgaaggaggtggtgggacatgccaaggagactggagagaaagccattgctgaagccataaagaaagcccaggagtcaggggacaaaaagatgaaggaaatcaccgagacagtgaccaacacagtcacaaatgccatcacccatgcagcagaaagtctggacaaacttggacagtgagtgcacctgctaccacggcccttccccagtctcaataaaaagccatgacatgtgta

SEQ ID NO: 132652 - DNA, 1353 bp, Homo sapiens
  Payload ID: 5915
  Gene Symbol: FAM26D
  Gene Name: family with sequence similarity 26, member D
  Uniprot ID: Q5JW98
  ENST ID: ENST00000368596
  CDS Start-End: 45-989
gatcagaaagggccacaagctgatttgtgtaacagcttcccaagatgtgcccaactctcaacaatattgtgtcttctctgcagagaaatggaatatttatcaattctttaattgcagccttgactattggtgggcaacaactcttctcctcttctacattcagctgtccttgtcaggttggaaaaaatttctattatggttctgcttttcttgtcattcctgccttgatccttctcgttgctggctttgctctgagaagccaaatgtggacaattaccggtgaatactgctgcagctgtgcccctccatacaggagaatcagccccctagagtgcaagctggcttgccttaggttcttcagcatcactgggagggcagttattgctcctttaacttggctggcggtgaccctgctgacaggcacgtattatgaatgtgcagcaagtgaatttgcatctgtggaccattacccaatgtttgataatgtcagtgccagcaaacgagaagagatcctggctgggtttccatgttgcagatcagctccttctgacgtgatcctagtaagagatgaaatagctcttctgcacagataccagtcacagatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaa

SEQ ID NO: 132653 - DNA, 1311 bp, Homo sapiens
  Payload ID: 5915
  Gene Symbol: FAM26D
  Gene Name: family with sequence similarity 26, member D
  Uniprot ID: Q5JW98
  ENST ID: ENST00000368597
  CDS Start-End: 268-654
cccctgcctacactgtgctgagaactgctctctctgaccgggtctcctgtttctacctggtttgttgtgaacctgtgttctccacatttgtcctgactcttcaggtgaataactgagcctttcacttggctttgctgcaacccttcagctctgtgcgtgttggaagcaagaattggataagacttctcaggcgtctgcacaatccctaatggcccccagatctgccaaggagaccttcaggataaacccaaatgtagcagcaaatttatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaagtgtttagcacagtgtctttcataaaaatagatgctaatgaatgttactttctctctttctcttttgcattccatgtcttctattcaccattttccctgcctctattttctggttttatcagtttctacctttatataatgtccagaacttttcacagcctccccctctttcttcagacctaaatatctgaccttttgggaagcaggacagaaacctctttctaatccagtaacatgtgagggagaagcccatgcaggaagctcttgagttactgtactataacctggggaca

SEQ ID NO: 132654 - DNA, 1165 bp, Homo sapiens
  Payload ID: 5915
  Gene Symbol: FAM26D
  Gene Name: family with sequence similarity 26, member D
  Uniprot ID: Q5JW98
  ENST ID: ENST00000405399
  CDS Start-End: 286-801
gtgctgagaactgctctctctgaccgggtctcctgtttctacctggtttgttgtgaacctgtgttctccacatttgtcctgactcttcaggtgaataactgagcctttcacttggctttgctgcaacccttcagctctgtgcgtgttggaagcaagaattggataagacttctcaggcgtctgcacaatccctaatggcccccagatctgccaaggagaccttcaggataaacccaaatgtagcagcaaatttcaagtgaatttgcatctgtggaccattacccaatgtttgataatgtcagtgccagcaaacgagaagagatcctggctgggtttccatgttgcagatcagctccttctgacgtgatcctagtaagagatgaaatagctcttctgcacagataccagtcacagatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaa

SEQ ID NO: 132655 - DNA, 568 bp, Homo sapiens
  Payload ID: 5915
  Gene Symbol: FAM26D
  Gene Name: family with sequence similarity 26, member D
  ENST ID: ENST00000452373
  CDS Start-End: 199-568
gtgctgagaactgctctctctgaccgggtctcctgtttctacctggtttgttgtgaacctgtgttctccacatttgtcctgactcttcagttggaagcaagaattggataagacttctcaggcgtctgcacaatccctaatggcccccagatctgccaaggagaccttcaggataaacccaaatgtagcagcaaatttatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggta

SEQ ID NO: 132656 - DNA, 1117 bp, Homo sapiens
  Payload ID: 5915
  Gene Symbol: FAM26D
  Gene Name: family with sequence similarity 26, member D
  Uniprot ID: Q5JW98
  ENST ID: ENST00000628083
  CDS Start-End: 228-740
tgttttacccttgggtcctcccctgcctacactgtgctgagaactgctctctctgaccgggtctcctgtttctacctggtttgttgtgaacctgtgttctccacatttgtcctgactcttcaggtgaataactgagcctttcacttggctttgctgcaacccttcagctctgtgcgtgttggaagcaagaattggataagacttctcaggcgtctgcacaatccctaatggcccccagatctgccaaggagaccttcaggataaacccaaatgtagcagcaaatttatcagctccttctgacgtgatcctagtaagagatgaaatagctcttctgcacagataccagtcacagatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaagtgtttagcacag

SEQ ID NO: 132657 - DNA, 9784 bp, Homo sapiens
  Payload ID: 5916
  Gene Symbol: FAM26E
  Gene Name: family with sequence similarity 26, member E
  Uniprot ID: Q8N5C1
  ENST ID: ENST00000368599
  CDS Start-End: 52-981
ctgctctgccaataacaaaggcacagcattttccctctgtgcatctccaacatggatgcttttcagggcattttaaaattcttccttaatcagaaaactgttattggctacagcttcatggctctgctgaccgtgggaagtgagcgtctcttttctgttgtggcttttaagtgcccctgcagcactgagaatatgacctatgggctggttttcctctttgctcctgcctgggtgttactgatcctgggattctttctgaacaataggtcgtggagactcttcacaggctgctgtgtgaatcccaggaaaatctttcccagaggccacagctgccgtttcttctacgtcctcggccagatcactctgagctcattggtggctccagtgatgtggctttctgtggctctgctcaatggaactttctatgaatgtgccatgagcgggacgagaagttcaggactcctggaactgatttgcaagggtaagcccaaagagtgctgggaagaacttcacaaagtatcttgtggcaaaactagcatgctacctaccgtcaatgaagaactgaaactctcccttcaggcccagtctcagattctaggatggtgcctgatttgttcagcgtctttcttctctctgctcaccacatgttatgctcgctgccgatctaaagttagctaccttcagctgagtttttggaagacatatgcacaaaaggagaaggagcagttggaaaatacatttctggactatgccaacaagctgagcgagaggaacctgaaatgtttttttgaaaacaagaggccagatccttttcccatgcctacgtttgctgcctgggaggctgcttcagagctgcattctttccaccaaagccagcaacactatagcaccctccacagagtggtggacaatggtctgcaacttagccctgaggatgatgagacgacaatggtccttgtgggtactgcccacaatatgtagctcatccaccatcaatgactcatggtgttgagtggcatgctcattctgtgatcctcctaacgtatcaccagcaacctgtgtgtctctgtattttcttacatttggagtatgtttacaagacaataacacaaaggaaactgctttgaagctctcaagtggaacatcaggatgtgctcaaattgatgctgaggggtgacaaaggtgctcttgcattggtggagaggggctcagtaggcctaaatgttgctccaagatctaagattttatcattcaacagacagactcatgtgagagggctcatcagtctctgtaaatattggttgcagaatttaggggcagaagcaatggcttgtgagtgagcaagttactcttaacataggttgccctacacagtggctcctgcagtgtgatcagcaggagtctctgtcctacaaatctacacttttaaggatgtatgaaattgtggaattcattccctcaggatctgaagatctcagttctcaaaaatcacaagttgcaagaatatgatacctaaaattgaaagtttttcacatgttttcactgtatactgaaaatactcccctggaagcagggctgcatcataatttttgtgggctttatgtacttttgcctttgcgaaccatttcctacattcaaaatagtagtaacaaatatatatatatatatatatatatatatatatatatatatatatatatacacacacacagaaatatatatttataactgcattgataaaaggtgaatatattagcattttcttcaacctaaaagtttatgtattttcttctgattttaaaagaaattaaaaacattttagtgggcccttacaagtattatggtccttaggcacagtgcttactaggccgtgggtatgtcttagtgcgtttgggctactataacaaaatatcatagataggtggcttatacaaaatagaaatttatttctcacagttctggaggctgggaagtccgaggtcaggctgccagcatgctcaggttctggtgagagcaattttccaggttgcaaactgcttgctgacttctcagtgtccttccatggtggaaagtgcaaataagctcccttgagcatttttataaggcactaatcccattcctggaggctccaccttcatgacccaattacttctcaaggctctgcttcttagtactatcagcttgggggttaagatttcaacatatgaaattgggggagacacaaacattcagactatagtagggtaaattgaccttggctaaaggtctggggacactgtccaaagcagtactggcataaaactgcattgcagtcttacatttatcagaaataatgcaaatcttgcattctacaatgtactatatccatgttagtatgtacatatatatgtgtatgtatatatgtacataaattctccttaaatctctgagaagaattgtgctttaaaaaagaactatgttttgtgctgtggctcataccttacagtggtagtctatgtctcttagtttgagaaagctgaatattaacttcttattaacatgaaacatgatggcaaactgaatcctacaagtataggacccagaacatatctatgttattgtcatttacaagaagaaatatgtatttggtctttcttcctattcctggtgcagagctcctaaaacctttgggacctcccaagtgatgtgtctggtagtacgcgaatgagatgactgatagttaggggcttctgaatggcctcagaatagggtctggttgccacgggaaccaaccatgtgtttagagggttggaactttcagccccactcccagaccttggggaaggaagaggggctgaaggttgagtcgatcacaaatggataatgatttaatcaatcatgcctaagaataaagcttcccataaaaatctaaaggacaaggttcagagagcttctgcattgctcaatacatgaggagtggtgagcccaaaggggccgtggaagctccgtgccccttcccccaaacctgttcctgtgcctccatctggctgtttctgagttatattattttataatagactgatgatagtaaataaagccctttcctgagttctgtgagctactctagcaaatggtgaaatctgagaaggaaatcatgggaacctctgctttgtagccacgtcagatagaagatgtgagtaactttggaacctactgcttgtgactggtgtctgaagttgggggagatcttatgggactgagctcttaacctgctggggatctgcacttaatgccgattaatgccagaattgaattgtatgatatccagttggtattggagaattggccagtgtgggagaaaacccacacagttggtggcaaggagtgttcagtgttgagtgtgaatgtcaataaaaaaaggtttgttttttctacgtacaatatctttgggaacttggaggtgcagggtcagacgtctgtgtgtgtatgtggcagggacagaacagggattagggatgtgagggggtagagttttcagaataaagggagagaaaattcagcaaagagttctccttcttaatctttcttgacttaaagtttgtctgcccttaagtgtcttctgagctggaaaaagacatataggaactggccgatgccgatgcctcttttgcagtgtgtgagaggctgaaacagaagttctacagaagtaggttagctgtaaggagctgaggattgaggagtcatatctgggggatattcctgccaccctcaagtccagggactttctgcactcaaaaaacttacgctcatgacaatgactgcctcattcaagaaaacccaagctgactggcaagaagccagcagcctgggtacttgttgctgcagcttagtaagtagcagaagagctcatcctcctcctctggaagaagccacttaacaggttctcatcctgactcctaaattccttaacagtcctttactcaggaataaaacaagtccaagaaaacttatctgtcccacaaatagtcctggaggcagtggagtaagatagggagagcaaattggtgtctgctcttgagtatcttgagggaatgggtatctagaggcagcaggatgaactggctttgatagcagagactttaaaatgtgtggaccattagttgtctttggatgtgctccctagaggctgcgcctgacacagggagctgtgtatacatgatttattaaaaggaaatcctcttaggagaaacatattagcaggataaacacaagaaagaatgcagttacaagtggagtctcaatcaatcccagaggaaattctgggacttcagcctcagcttgacctatgggggggctctggaatgtcagatttctcctgatcccaagtgtgctctggggcttccattgcagccaagagagagcattccccagaaaactccaggtgaggagtctccagtggcccaagggtgatcctccagaggaggttacactgccgaactgggacattggcaccctggatttgaatatctagagagggcacccaatggtcatactaatgtttgccataacagtctcttctaggtctagacttgaagcatatggaagggtccttgggctagagccaacccaagcccaggctgactcccttttaatacttctaattttccctgaagatctggtcttctccctaccaccactaccctattacataagagaaaaggattggagaatgctcttgaaaagaatgtgatgctttcccatacaaggaatatactcaaggaaaaatttcatggcacaaaatgctgattctgtccaatttatcccatgaataaattgtgtacacatatatatatgattcttttgtttttcctgtgcagttccttccttttttcaggctcaaccacttaattcagctttaggatacattcagcttattcatatcaaatataaagtgggagaaaaaaaggtatgtaacaaagattacaaaaataaggcatggcagacaaatcactacataattctatgcattataccttaaagtaatgtattgtaaaatatatgtgtccaaagcaacttttaaaatttttgtatggttttctacttgagacctttaaagcatcactaaaaatgtatacatttaatgagaaaacgatgacattattgattcaaattagttgtttcaaagcctgatgatccactgatttactctaaaaactggttaaagcaatccagaagtcactgggtagcagaaaactgctaccgcttctcacatgatatatttcaagtacttcaactattaactatattattctatttagactttggtggttccgaattctctaaggtaattatcttaattttctaatatttccctctcatttttctctcttattttaaatatcccctgttgtacaagccagaggatattaatttcctttgtgggtagtgcttggacttctctgattttagatcccaaaatcattaagaaaaagctaagaggttggcatgagaggttggatggaaagcatctatctgtgtttgtcagtagctctcgatgttggctgcaaattggaatcacctgggggcctttgacaatcacaatgtctggacccatttcctgagaacctgatgtaacttttctgggttagggcctgaacattgagatttcttttaaaagctttctaagtgattataatgtgcagtcatggtgaagaactactgattttatatggggagtcagtgaaggtggtgaggggctgtgaggttgaaatattggaaatgttatctggatttcaaacagtagagtatgataaaaatttaaaaactggctctccaggaaaaaagagacatcctaatatgatgtatttgccaatataccatgggttttcttgggctgggatgaactttcagaagttttacagtgagcatttttttttttatgaatttaaattggttctagctaagcaattttggagtatctttgatgtacctgggtctctcattttaataaacataacagtggtatgttagtcagggttctccagagaaacagaaccaacagtacaacagtatatatacatacatacatatatatgtgtgtgcatgtgtgtgtgtgtatgcgtgtatatatatatatgctacatatatgaaaggggatttcttgtgggaatatatattatatataacaaaacatgacaaatatataacaaaatatatgtgctatatatattgtgtgtgtatatatatatgaaagaggatttattgtggaaattggctcatgtgattatgaaggctgagaaggcccatgacgtgccacctgtaagctggagaatcagggaaatgtgtagggtggctcaagtcccagtctgagggcctgagaaccaggggagttgatggtacaaatcccagagccaaaggcaaaggaacctgaagtttttatttccaagggccaatagataaggagaatattggtgacccaactccaggagacagagaaaagattggtgacccaactcgagtggagagagagggagagagagagagacagagagcaaatttgcccatcctctccctttttgtcctacccaggccctcaatggattgtatggtgcctgcccaggttaggtgagggcagattttccttactcagtccactgattcaaatgccaatcttttttggaaacacccctacatacatacccagaaataatgctttaataactatctggctaccccttaatccaatcaagttgacatctaaaattaaccagcacatgtgataaattaaatatggttcaatggctccttctggcagatgtagtcgtgttatcctcactttgaatctgaccttatgaaccaataaaatatggcagacatgaggtagattgttaagcagtatcacagtttatgccttggtctcttacaatgttgcaatgctcaacagtctggtaaaagccactatgtaagaactgcaattactcagggactaccaagctctgaagaggcccaagctagccagtgggaggagagagagagagataaaaagagagagagagagagatcccaatggctccaattgtctcagatattctagcttaggggtcaggcatgtgaatgaaggagccattttaaacattcaggccccagtgtacacgacatggagaagaaccaggaagtccaaccaacagtgagaataaaaggccccagatctatggccctaatcaaatcattgcagccatctccaaacatttgacccactccagtggaggctgcaggctttgtagagaagtccttgccatgtcctatccaactccatgaccccaaaaatcatgagcttaaataaatgtttgtggctttaagccactgaattttggggcaatatgaagcgacagaacctgaacactaacatgaaaatcagaatttataaaaagacaaaaattacaggcaaattgtatttatacatttatacattctccctatgcatagagagcattttcttcaatcatgttttctttttctttaggttccagttagcagtatagcatctacagcatgatttgatagatgctgataagtaggtctctaaaatctctccaccaaagctggagattcactttcaattatttttggttaatttttgtttgaaaggaatacaaacatattattgggaggagtaacacattaaactattatttgtcattaatatctacgaaaaaatagcaagtgagggtttcagactaggctggccttcagtaagctggaaagagattgttcttctagtcgtctctcaaaatgttatcttcagactgtcaacatcagtatcacgatgaagcttgttagaaatgcagaatcagacagtatctaaaacctgttgagtcaagcctgcagtttaacgtgatcctagctgattccagttcaagctaaatttgataacactaaggcagtggttctcaaactttagtccatataaaaatcatctggagggcttattaaaatgtggattgctgaactccacccccagggtgtctgattcagtaggtctggggtgaggcaagataatctgcatttctaacaggttctcaggtgatactgatgctgctggtctagggactacatcttgaaaataactgctctacagcacagagcaggctattctggggaaggcaggctgtaagaaactcagaatcctggcctgcactccagatctactgaatcggtcatcagcccgtccaagattttggggtgcctttccattcattcaaggatacctttctattcattcaaggatatattttgtcctttaggaatattttaaagtttacttcacataagttttacatgtttcttgtaaactctatttgtaggtgttttctttgttcctgttgtaaatggtttcttttttccactatatctttctaagtgattgttgtctgagtacgtgaaaagctattgtcttatgcttattaattttatctctctactaattcttttattgtttgtagggcttttcagaatttgaaagtaaacattttgcaacctttgatgacaaaatggatctagacaataaataatgaattctaaactattaggtgaaagcagaatggggtcagacctatgcaatttgaagccactcatctatattagcatcactaaaaatcaaagcagatgctacgtgccttatgatgcaaggcaagaataagtacatagtatcacatgtgaaatattgtttcctaagaagctaaacctaatcaagtatttagacattactgctagtttataggaaacataagcaacaaaaaacaaggcaattagcaccacaaaaaaacaaccaggtacatctagatctaacagaacattccattttacagatgactcagtctccccacagattaacagtattaagaaaggagaataaaggagatataagtgacttaataaccagatatgctatatagaccttatttgtatcctgtttccaacaaccaactgtaacaagatatctttgagatatttaggaaaatatgaatgaatattagatgatttttagagaattattaattttgctatgtgtggtaatggtgtgccgatttatgttttttaaaaagttcttcagttagagatgtatatttaaatatttatgtgtgaactgccatgatgtctagaagtttctttaaaatactctagaaaaaagagtttagggagaaagctgaaagatgaaataagattggcaaaatatggaaactattgaagctggatggtaggtacacggaattcattacattattctctttacatttgtatatgtttgaaaaatttcataaggtacacaacaaaataaatgacatggtcacctcagttattttgctgaagttttgtcaatcaccccctgcttagctggagtttaccttctagtatcattctcagcaaaggctcacaggaatgctattctctgaattcttacatattcagcctgttggcctgttctcgaattgaaggacagcttgtctggttcatactttctctacatgagtgtattgtaagcattacttcattgtcttttgtcattgaatattgctgaggtggccacagcctgatttctgatgccatctctatttctttctttattactaacaagatgttttatcctatattctcattggtttctttatctttcatgtccaaaaatgttaaataggccttcaggtaggtctttttggaacgatttttcctgctacaagtttactctttcattgtggagaatcattttcttatatttcaataaaaaagttggaaaattttcaactta

SEQ ID NO: 132658 - DNA, 540 bp, Homo sapiens
  Payload ID: 5917
  Gene Symbol: FAM26F
  Gene Name: family with sequence similarity 26, member F
  ENST ID: ENST00000368604
  CDS Start-End: 1-477
cgctgggggcgtttgggaggagccgagaggccgagctttctcagggccgctggggtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattg

SEQ ID NO: 132659 - DNA, 1117 bp, Homo sapiens
  Payload ID: 5917
  Gene Symbol: FAM26F
  Gene Name: family with sequence similarity 26, member F
  Uniprot ID: Q5R3K3
  ENST ID: ENST00000368605
  CDS Start-End: 96-1043
agaggaaccagaaatttgtccttgaataatgtttcccgacaacgaagaggcagaaggatctgggcctgtgcgcgacgccccgggggacgaggctcatggagaagtttcgggcggtgctggacctgcacgtcaagcaccacagcgccttgggctacggcctggtgaccctgctgacggcgggcggggagcgcatcttctccgccgtggcattccagtgcccgtgcagcgccgcctggaacctgccctacggcctggtcttcttgctggtgccggcgctcgcgctcttcctcctgggctacgtgctgagcgcacgcacgtggcgcctgctcaccggatgctgctccagcgcccgcgcgagttgcggatcggcgctgcgcggctccctggtgtgcacgcaaatcagcgcggccgccgcgctcgcgcccctcacctgggtggccgtggcgctgctcgggggcgccttttacgagtgcgcggccaccgggagcgcggccttcgcgcagcgcctgtgcctcggccgcaaccgcagctgcgccgcggagctgccgctggtgccgtgcaaccaggccaaggcgtcggacgtgcaggacctcctgaaggatctgaaggctcagtcgcaggtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggtattttttga

SEQ ID NO: 132660 - DNA, 546 bp, Homo sapiens
  Payload ID: 5917
  Gene Symbol: FAM26F
  Gene Name: family with sequence similarity 26, member F
  Uniprot ID: Q5R3K3
  ENST ID: ENST00000368606
  CDS Start-End: 52-483
actttgctgatttagcttatggaagaggaaccagaaatttgtccttgaataatgtttcccgtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattg

SEQ ID NO: 132661 - DNA, 1815 bp, Homo sapiens
  Payload ID: 5918
  Gene Symbol: FAM3A
  Gene Name: family with sequence similarity 3, member A
  ENST ID: ENST00000322269
  CDS Start-End: 430-1164
cttagccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaagaaatgccttc

SEQ ID NO: 132662 - DNA, 1712 bp, Homo sapiens
  Payload ID: 5918
  Gene Symbol: FAM3A
  Gene Name: family with sequence similarity 3, member A
  Uniprot ID: P98173
  ENST ID: ENST00000359889
  CDS Start-End: 368-1060
cgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaagaaatgccttca

SEQ ID NO: 132663 - DNA, 1359 bp, Homo sapiens
  Payload ID: 5918
  Gene Symbol: FAM3A
  Gene Name: family with sequence similarity 3, member A
  ENST ID: ENST00000369641
  CDS Start-End: 370-1083
gccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgggcccctccctcctgacacaggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccc

SEQ ID NO: 132664 - DNA, 1521 bp, Homo sapiens
  Payload ID: 5918
  Gene Symbol: FAM3A
  Gene Name: family with sequence similarity 3, member A
  Uniprot ID: P98173
  ENST ID: ENST00000369643
  CDS Start-End: 189-881
agagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaa

SEQ ID NO: 132665 - DNA, 1041 bp, Homo sapiens
  Payload ID: 5918
  Gene Symbol: FAM3A
  Gene Name: family with sequence similarity 3, member A
  Uniprot ID: P98173
  ENST ID: ENST00000393572
  CDS Start-End: 292-870
ctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggg

SEQ ID NO: 132666 - DNA, 706 bp, Homo sapiens
  Payload ID: 5918
  Gene Symbol: FAM3A
  Gene Name: family with sequence similarity 3, member A
  ENST ID: ENST00000433619
  CDS Start-End: 458-670
gccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccatgtctcactttgtctcccaggctggagtgcagtggtgcaatctcggttcactgcaacctctacctcctgggttcaagcgattctagtgccccagcctcccgagtagctgagactacaggtcc

SEQ ID NO: 132667 - DNA, 1763 bp, Homo sapiens
  Payload ID: 5918
  Gene Symbol: FAM3A
  Gene Name: family with sequence similarity 3, member A
  Uniprot ID: P98173
  ENST ID: ENST00000419205
  CDS Start-End: 471-1112
cttagccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaagaaatgccttc

SEQ ID NO: 132668 - DNA, 1817 bp, Homo sapiens
  Payload ID: 5918
  Gene Symbol: FAM3A
  Gene Name: family with sequence similarity 3, member A
  ENST ID: ENST00000434658
  CDS Start-End: 471-683
cttagccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctag

SEQ ID NO: 132669 - DNA, 936 bp, Homo sapiens
  Payload ID: 5918
  Gene Symbol: FAM3A
  Gene Name: family with sequence similarity 3, member A
  ENST ID: ENST00000426266
  CDS Start-End: 446-936
tggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgggcccctccctcctgacacaggggtcagcggcgagctcatcgaggcccgggcctttgacatgtgggccggagatgtcaacgacctgttgaagtttattcggccactgcacgaaggcaccctggtgttcgtggcatcctacgacgacccagccaccaa

SEQ ID NO: 132670 - DNA, 832 bp, Homo sapiens
  Payload ID: 5918
  Gene Symbol: FAM3A
  Gene Name: family with sequence similarity 3, member A
  ENST ID: ENST00000412894
  CDS Start-End: 399-518
gtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggtccagagagctcggtgactgcagtaacagaaaatccttctgtcttgggtccctgtggcctcaccagtaggacacagagtatggaagtgtccccagcctcggcctgagccacatccccctacttgtgtcctgctctgcggtcacttgttctaccatgtgtgctggtcctgacctccccttcagatctcaggtgacctcagggccaggcccatggataacacctgctatccctgcccagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacg

SEQ ID NO: 132671 - DNA, 441 bp, Homo sapiens
  Payload ID: 5918
  Gene Symbol: FAM3A
  Gene Name: family with sequence similarity 3, member A
  ENST ID: ENST00000440318
  CDS Start-End: 50-205
cccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcaggctgatgagcagcgtcaaggacaacgtgggccgcgggctgaacatcgccctggtgaacggggtcagcggcgagctcatcgaggcccgggcctttgacatgtgggccggaggtgagttgcagcgcagcgtcttgcattttgactgcagcaaaatgacctgggcagcttcccctgagacactgctctctctgtctgtacttggagcttctcagtcacctccgtgggttcagaaaggacagggg

SEQ ID NO: 132672 - DNA, 1056 bp, Homo sapiens
  Payload ID: 5918
  Gene Symbol: FAM3A
  Gene Name: family with sequence similarity 3, member A
  ENST ID: ENST00000449971
  CDS Start-End: 362-574
tgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcag

SEQ ID NO: 132673 - DNA, 853 bp, Homo sapiens
  Payload ID: 5918
  Gene Symbol: FAM3A
  Gene Name: family with sequence similarity 3, member A
  ENST ID: ENST00000421517
  CDS Start-End: 394-606
cgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagatctcaggtgacctcagggccaggcccatggataacacctgctatccctgcccagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggcc

SEQ ID NO: 132674 - DNA, 905 bp, Homo sapiens
  Payload ID: 5918
  Gene Symbol: FAM3A
  Gene Name: family with sequence similarity 3, member A
  ENST ID: ENST00000457212
  CDS Start-End: 466-627
ccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagatctcaggtgacctcagggccaggcccatggataacacctgctatccctgcccagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggag

SEQ ID NO: 132675 - DNA, 500 bp, Homo sapiens
  Payload ID: 5918
  Gene Symbol: FAM3A
  Gene Name: family with sequence similarity 3, member A
  ENST ID: ENST00000442929
  CDS Start-End: 438-500
ctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggtccagagagctcggtgactgcagcgccacgggccaggaagtacaagtgt

SEQ ID NO: 132676 - DNA, 1113 bp, Homo sapiens
  Payload ID: 5918
  Gene Symbol: FAM3A
  Gene Name: family with sequence similarity 3, member A
  ENST ID: ENST00000416319
  CDS Start-End: 347-580
gccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagtaacagaaaatccttctgtcttgggtccctgtggcctcaccagtaggacacagagtatggaagtgtccccagcctcggcctgagccacatccccctacttgtgtcctgctctgcggtcacttgttctaccatgtgtgctggtcctgacctccccttcagatctcaggtgacctcagggccaggcccatggataacacctgctatccctgcccagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgt

SEQ ID NO: 132677 - DNA, 1800 bp, Homo sapiens
  Payload ID: 5918
  Gene Symbol: FAM3A
  Gene Name: family with sequence similarity 3, member A
  Uniprot ID: P98173
  ENST ID: ENST00000447601
  CDS Start-End: 468-1160
agccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaa

SEQ ID NO: 132678 - DNA, 1901 bp, Homo sapiens
  Payload ID: 5918
  Gene Symbol: FAM3A
  Gene Name: family with sequence similarity 3, member A
  ENST ID: ENST00000621967
  CDS Start-End: 471-683
cttagccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaa

SEQ ID NO: 132679 - DNA, 1088 bp, Homo sapiens
  Payload ID: 5919
  Gene Symbol: FAM3B
  Gene Name: family with sequence similarity 3, member B
  Uniprot ID: P58499
  ENST ID: ENST00000357985
  CDS Start-End: 147-854
tttgcccgactggccgcgcacccagctggcccgcccctgcccgacacgaccgctgcccgccccttgccttcctgacccaggggctccgctggctgcggtcgcctgggagctgccgccagggccaggaggggagcggcacctggaagatgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaa

SEQ ID NO: 132680 - DNA, 1026 bp, Homo sapiens
  Payload ID: 5919
  Gene Symbol: FAM3B
  Gene Name: family with sequence similarity 3, member B
  ENST ID: ENST00000398646
  CDS Start-End: 16-792
tgacactgggccgggatgaaaagccacaggggggatggggagggccaagggccagggccgccaccaagtcgttcacagcagctgcttggtgtcctctctgcaggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaa

SEQ ID NO: 132681 - DNA, 864 bp, Homo sapiens
  Payload ID: 5919
  Gene Symbol: FAM3B
  Gene Name: family with sequence similarity 3, member B
  Uniprot ID: P58499
  ENST ID: ENST00000398647
  CDS Start-End: 67-630
gggctccgctggctgcggtcgcctgggagctgccgccagggccaggaggggagcggcacctggaagatgcgcccattggctggtgctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaa

SEQ ID NO: 132682 - DNA, 1125 bp, Homo sapiens
  Payload ID: 5919
  Gene Symbol: FAM3B
  Gene Name: family with sequence similarity 3, member B
  Uniprot ID: P58499
  ENST ID: ENST00000398652
  CDS Start-End: 67-891
gggctccgctggctgcggtcgcctgggagctgccgccagggccaggaggggagcggcacctggaagatgcgcccattggctggtggttcacgttgggcatgctggctcacaaggtgcttgattagctgctttgacataaacgttcaaggacgtttgttggttaagttaagacctaaaccaacagcaaatacaacttgccctggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaa

SEQ ID NO: 132683 - DNA, 2508 bp, Homo sapiens
  Payload ID: 5920
  Gene Symbol: FAM3C
  Gene Name: family with sequence similarity 3, member C
  Uniprot ID: Q92520
  ENST ID: ENST00000359943
  CDS Start-End: 215-898
agcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtgaa

SEQ ID NO: 132684 - DNA, 561 bp, Homo sapiens
  Payload ID: 5920
  Gene Symbol: FAM3C
  Gene Name: family with sequence similarity 3, member C
  ENST ID: ENST00000412653
  CDS Start-End: 108-561
gtcgcggccgggaagcgtgggaggaggcccagcggcgagctggctttctcctggccacttgccggggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatg

SEQ ID NO: 132685 - DNA, 662 bp, Homo sapiens
  Payload ID: 5920
  Gene Symbol: FAM3C
  Gene Name: family with sequence similarity 3, member C
  ENST ID: ENST00000426156
  CDS Start-End: 335-662
acttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccggagcatattaatgaaaagtgccataaactgaaaaaccaaacatgagggtagcaggacagggaaaagttatctctggttgcatgtgcctatgattgctagaaaataagatggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatac

SEQ ID NO: 132686 - DNA, 1319 bp, Homo sapiens
  Payload ID: 5921
  Gene Symbol: FAM3D
  Gene Name: family with sequence similarity 3, member D
  Uniprot ID: Q96BQ1
  ENST ID: ENST00000358781
  CDS Start-End: 312-986
gttgatggcaaacttcctcaaaggaggggcagagcctgcgcagggcaggagcagctggcccactggcggcccgcaacactccgtctcaccctctgggcccactgcatctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggaccaaaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaa

SEQ ID NO: 132687 - DNA, 737 bp, Homo sapiens
  Payload ID: 5921
  Gene Symbol: FAM3D
  Gene Name: family with sequence similarity 3, member D
  ENST ID: ENST00000483787
  CDS Start-End: 284-737
cagtcctgggccccagctccagagcactcacgggctgccagggtgagcaggctagaaactcacgacaccaggtagctctgcaggtgctgggagggcaactcagcccagaggaagagcaggctggggagccctcaccgcccaatggggactgacccctggcccctgcccctctccaccccactgccctgaagccagatttcctgctcagcatggacaggacagcaagaggctaaccctctgcccaggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggacca

SEQ ID NO: 132688 - DNA, 633 bp, Homo sapiens
  Payload ID: 5921
  Gene Symbol: FAM3D
  Gene Name: family with sequence similarity 3, member D
  ENST ID: ENST00000489857
  CDS Start-End: 298-633
tcctcaaaggaggggcagagcctgcgcagggcaggagcagctggcccactggcggcccgcaacactccgtctcaccctctgggcccactgcatctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgat

SEQ ID NO: 132689 - DNA, 625 bp, Homo sapiens
  Payload ID: 5921
  Gene Symbol: FAM3D
  Gene Name: family with sequence similarity 3, member D
  ENST ID: ENST00000482623
  CDS Start-End: 214-333
ggtagctctgcaggtgctgggagggcaactcagcccagaggaagagcaggctggggagccctcaccgcccaatggggactgacccctggcccctgcccctctccaccccactgccctgaagccagatttcctgctcagcatggacaggacagcaagaggctaaccctctgcccaggtggaagctgaccccaagccacccttcacctggacaggatgagagtgtcagcccccagcccccaacctccatcctgcaggagggtccgaagtgcttttcctctaaccagattctgtcttctctccagcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgac

SEQ ID NO: 132690 - DNA, 449 bp, Homo sapiens
  Payload ID: 5921
  Gene Symbol: FAM3D
  Gene Name: family with sequence similarity 3, member D
  ENST ID: ENST00000498347
  CDS Start-End: 142-449
ccagagcactcacgggctgccagggtgagcaggctagaaactcacgacaccagatttcctgctcagcatggacaggacagcaagaggctaaccctctgcccaggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacat

SEQ ID NO: 132691 - DNA, 1455 bp, Homo sapiens
  Payload ID: 5922
  Gene Symbol: FAM32A
  Gene Name: family with sequence similarity 32, member A
  Uniprot ID: Q9Y421
  ENST ID: ENST00000263384
  CDS Start-End: 26-364
agctaccgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaa

SEQ ID NO: 132692 - DNA, 798 bp, Homo sapiens
  Payload ID: 5922
  Gene Symbol: FAM32A
  Gene Name: family with sequence similarity 32, member A
  ENST ID: ENST00000588367
  CDS Start-End: 21-305
ccgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcgggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagcc

SEQ ID NO: 132693 - DNA, 1168 bp, Homo sapiens
  Payload ID: 5922
  Gene Symbol: FAM32A
  Gene Name: family with sequence similarity 32, member A
  Uniprot ID: Q9Y421
  ENST ID: ENST00000589852
  CDS Start-End: 231-509
gcggaaatagtgtttgcaaacaggaagtgtggcactccagctaccgaagcactggagagtgtcatggaggcctacgagcaggtccaaaagggacccctgaagctgaaaggcgtcgcagagctgggagtgaccaagcggtgaggcccgagggcccgcgggattccgtcttcatcccccttagaccttttctcgggacccctggccctgatcctccgacccgccgcctcctcatgtctttttccaggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtg

SEQ ID NO: 132694 - DNA, 401 bp, Homo sapiens
  Payload ID: 5922
  Gene Symbol: FAM32A
  Gene Name: family with sequence similarity 32, member A
  ENST ID: ENST00000587351
  CDS Start-End: 1-249
gagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggagatgcggtttcaccatgttggccaggctgatctcgaacttctgatctcaagtgatccgcccgcctcagcttcccaaagtgctgggattacaggcgtgagccaccgcacccagtctcagctgttgatattgaatggccatgcccatgacgactttgtttgtattgtattataaggctccgataaattattttttctt

SEQ ID NO: 132695 - DNA, 896 bp, Homo sapiens
  Payload ID: 5922
  Gene Symbol: FAM32A
  Gene Name: family with sequence similarity 32, member A
  ENST ID: ENST00000585831
  CDS Start-End: 11-334
ggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcagggccatcagacttcctgcacagcaactggcttccaagggcacaaagctaatgctgccaggtcttatgcatggacccagaactggtactgtgttccttcgagttaactgagtccacggccagcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggaccc

SEQ ID NO: 132696 - DNA, 3402 bp, Homo sapiens
  Payload ID: 5923
  Gene Symbol: FAM35A
  Gene Name: family with sequence similarity 35, member A
  Uniprot ID: Q86V20
  ENST ID: ENST00000298784
  CDS Start-End: 115-2622
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatg

SEQ ID NO: 132697 - DNA, 3614 bp, Homo sapiens
  Payload ID: 5923
  Gene Symbol: FAM35A
  Gene Name: family with sequence similarity 35, member A
  Uniprot ID: Q86V20
  ENST ID: ENST00000298786
  CDS Start-End: 115-2829
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaacaa

SEQ ID NO: 132698 - DNA, 969 bp, Homo sapiens
  Payload ID: 5923
  Gene Symbol: FAM35A
  Gene Name: family with sequence similarity 35, member A
  ENST ID: ENST00000437629
  CDS Start-End: 690-969
tccacagagccggccacatccgaggcggggtgacccgggcggggacccggcccgctccagctgggctgggctgggctgagcagcggccccgcaccggcaggaggccggaggggagggccgcaggggaggcagggagggcgggacggggcccggccgacgctcacctcccttgcagggcgtgcggtgctggctgtgctgggcccggtagccttcgatgacctcccaggagccgtcgtcgcgccggatggggaaggagagactcagcacatggttgcagggcttgatgatccgcaggatgccgcgcacccggttccgcttctgctcctcgctctcccgggtcctcaggtcctccaccagcttgtcctccacgatgctggcgccgcgatcgaagaagccctccaccatcttgaagaagttggggtcgtcctcgcggtcggccaccgcctcgctgtagtggcgccgggcggccaatgccagccccggctgcggggcggcggcgggctgtccccgggcccagcccagcaacgcggccgagtcggcggacgccgagcccagggcagcgggcccggcccgggacagcaacagcgcttcgcccaggtagcggtacatggccacaagcggaggggagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtac

SEQ ID NO: 132699 - DNA, 2494 bp, Homo sapiens
  Payload ID: 5924
  Gene Symbol: FAM43A
  Gene Name: family with sequence similarity 43, member A
  Uniprot ID: Q8N2R8
  ENST ID: ENST00000329759
  CDS Start-End: 284-1555
tggggtaattctgtgtgcgcgcgtgtctcccccgcaccaaccttttttgcacactcgaagctgaatattttcttttttagagaatttacccgcacctcctgcggggttcctaagcactctctctgctcccctccccccaactccctaccacagggccgctcccagtagttttattcttcgatcttgcccgggccgagcctggcaggggccggtggctcagcgggcctcgcacccggcgctccgccgccgccgccgcccagctgcgccggggcgccctccggagatgctgccgtggaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctgggcaatgccaccaccatccaggcgcgcggcgacggctgcaccgaccttgctgtgggcaagatctggagcaagagcgaggcgggccgtcagggcaccaagatgaagctgacggtgagtgcgcagggtatccgcatggtgcacgccgaggagcgcgcgctgcgccgcccgggccacctctacctgctgcaccgcgtcacctactgcgtggccgacgcgcggctgcccaaggtcttcgcctgggtgtaccggcacgagctgaagcacaaggccgtgatgctgcgctgccacgccgtgctggtgtccaagcccgaaaaggcgcaggccatggccctgctgctctaccagacgtcggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgccggggactcgtcccgccaggccgacggcgccagtgcagacgagccccactcgggctgagctcctccgcgcgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggttggctgaagttcctagtctcaggccgtaggtgcctggccagtttcctgtttgtggggcagctggggcctgaggaggaggggttcacttcctcctcccaccccctgggagcggccctgcgctgtcactgacatctcattaaaaaaaaaaaaaaatttgctctcaaggtgtttgaggctttaatgcaaccctttagcccttggttctttttggtgcaagaattctggctgtttacctcagactcagacccctgaaatgttgccaaattcttcaaataactgtttggggggtggggggagatgaaagagagtcgcgttttgtttacagttaaagacatccaatatcttaaaaaggagttttcctttagaaacacacacacccttcctcttgctcaaaagatctcactccatgatactgtgtaaaatatttttgcactgttgtgaagtatttttgacttttttctgtacataactgtgttctcagagctgaatgtttatatcttttgctgtgcaaaagaaacatgtaaaatgttgttcagttgtatatacagaaatgtgtataaaacattttgttattttttaaaagtagcactgttctggttctgtttgcacgccagtggggagagaataaagaggaaaatttaacagaa

SEQ ID NO: 132700 - DNA, 2572 bp, Homo sapiens
  Payload ID: 5925
  Gene Symbol: FAM43B
  Gene Name: family with sequence similarity 43, member B
  Uniprot ID: Q6ZT52
  ENST ID: ENST00000332947
  CDS Start-End: 536-1525
agcctgcgtggggggaggggagaagagggcaaggggaggggacaagagagctagcggtcccgcccggtgatgtaggcagcccggggaggtggagccgcgacgcctgaaggagtccccaccgcagccgcgctctcggtctgccccactaagcagccgccagcggctccggcgacccaaattgcggcggcagggaccgcggaaatcccaccgtttgggcttggtggacgtccagcccacctcacccccagccccggcccctcctcgcttcccagacggctggagacactcccgggaaaagcggtcctcagccactcggccgccgtccgcacctcggctgctggcccggctgggcaccgggcatctgcgaagctagccctgcctggcactgggcatctccaggcaacgactgtccccggccctgcccagcttctcgcgactccagggcggtggacttctgcgcgccttccctcccccggtctcccgacaggacgccggtgagctccctgcgcccccagcccctttcgccgccgccgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggctcagggtgatgcctgatacgcccttggttattggggggtgttcctctctccccacacccggagtttcccgggcctgccattgtggacccgccccctatgctttacacctagtctctttgcccacagacctcctcattccctcccaaaacatcctctcaagagaagggaggagaagtttcaagaaatcaggaggggtgggtttggaccctgggcagggtggaggcagtgaccttgcccttggtccctctagccttcttccctgtgcaaaaaaaaatgaccctggagaggcattcttgtaggagaagaatctagcggccggggagaattggggccgggccggcggtgggcagagtccgctgctatacacacagggaggaattctcacgcccaagccccgcctctctacgccttggaggactcctgtgacttcactgctctgcctctggagaacactgggagagtcctaccgacgttcaaacaacaggttaggccaggtaacagccctgcaccaggccgctgcccacgcctctgccctggcacccccaggggattccttgcccatcccatctctctgcagacggatgtgtgtggccccctcctaggtgccccacaaccaggaccaagatggggctcccaaaggaggtaaggagaacctttggcaggtgcttaggacactgactacctagaaagtagacgcagcagagttgctcccaagtcgaggctcctcagagcaggtgggtcctgacagcagtggattctcccagcaggatgaggaaggagggtgtgttaaccaaccaagggagtgggccccccacccaggtgtctccgcaagaccacaaaaagcccaaagatctatgtgtcactgatcattgtaaataaagtggacctgcttttacagc

SEQ ID NO: 132701 - DNA, 1648 bp, Homo sapiens
  Payload ID: 5926
  Gene Symbol: FAM45A
  Gene Name: family with sequence similarity 45, member A
  Uniprot ID: Q8TCE6
  ENST ID: ENST00000361432
  CDS Start-End: 27-1100
agagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaa

SEQ ID NO: 132702 - DNA, 2172 bp, Homo sapiens
  Payload ID: 5926
  Gene Symbol: FAM45A
  Gene Name: family with sequence similarity 45, member A
  ENST ID: ENST00000535029
  CDS Start-End: 45-710
gtcctgcaggcggcagccagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatgaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtgtaggactgaaacagtgaccttatattattgctaagggaatatgagattaacttcctacaggggccaaaaccagagaaaggcttccagcaacttcgatgaaagtagtttggccacatgtcaagccaattgtttgtactatttatgtacctttttcataactggaattgccaaataagcatggagatctaaatgatgtacttgttagtgtattcattcatattgactgtaaaggattatttttcactcagtactgatgtccttggaaatcttacctggaaacatgtttgc

SEQ ID NO: 132703 - DNA, 5609 bp, Homo sapiens
  Payload ID: 5927
  Gene Symbol: FAM46A
  Gene Name: family with sequence similarity 46, member A
  Uniprot ID: Q96IP4
  ENST ID: ENST00000320172
  CDS Start-End: 316-1644
aaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 132704 - DNA, 5664 bp, Homo sapiens
  Payload ID: 5927
  Gene Symbol: FAM46A
  Gene Name: family with sequence similarity 46, member A
  Uniprot ID: Q96IP4
  ENST ID: ENST00000369754
  CDS Start-End: 314-1699
aaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggtgacacagacgggactctcgcttgcgctttccagatgcatcagagatacttttggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 132705 - DNA, 5537 bp, Homo sapiens
  Payload ID: 5927
  Gene Symbol: FAM46A
  Gene Name: family with sequence similarity 46, member A
  ENST ID: ENST00000369756
  CDS Start-End: 1-1572
atgcagatgaggagggtgtggcgaacgtgccgctctgggccccggaagcgcagagaagcccggtataaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 132706 - DNA, 546 bp, Homo sapiens
  Payload ID: 5927
  Gene Symbol: FAM46A
  Gene Name: family with sequence similarity 46, member A
  ENST ID: ENST00000412306
  CDS Start-End: 1-265
gaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagaaagtcacacaaccacatattttctgaacataagctgaacttctacttccatggagtgagttacttcacctcattggcaaaagacaacagaagagtccaaagtctgaggggactgggcaagcttctgtcacatgctttcagaatgaagacaatctgcaagaattttaagttgtgacctctacagagaaaagaatgaaaagtagccaaatctccacatgagagattttggactattttgcagtgtaaaccccatctgatttatatgaagtaagcagactttctctccaagagttcaaaataaattaattctaatgctaaa

SEQ ID NO: 132707 - DNA, 356 bp, Homo sapiens
  Payload ID: 5927
  Gene Symbol: FAM46A
  Gene Name: family with sequence similarity 46, member A
  ENST ID: ENST00000423467
  CDS Start-End: 1-260
accaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggc

SEQ ID NO: 132708 - DNA, 2368 bp, Homo sapiens
  Payload ID: 5928
  Gene Symbol: FAM46B
  Gene Name: family with sequence similarity 46, member B
  Uniprot ID: Q96A09
  ENST ID: ENST00000289166
  CDS Start-End: 167-1444
gttagtcgtcgccgtctgaggtgttccctggctttgtctcgccgtcgttgccgccccgtccctgccttcgtgccccccgccttggcccctgcccagccgctctccctgtcctcctccccttaaccacccccacggtttctgccgtcggggcccgggggccgggcggatgatgccgtcggagagcggagctgagcgcagggaccgggcggctgctcaggtggggacggctgcggccacggcggtggccacggcagccccggcaggcggcggccccgacccggaggccttatcggccttccccggacggcacctgagtgggctgagctggccacaggtgaagcgactggacgctcttctgagcgagccgattcccattcacgggcgcggcaacttccccacgctgagcgtgcagccccggcagatcgtgcaggtggtccgcagcaccctggaggagcagggactacatgtgcacagtgtgcggctgcatggttcagctgccagccacgtgctgcaccctgagagtggcctgggctacaaggatctggacctggtgttccgggtggacctgcgcagtgaggcatccttccagctgaccaaggcagtggtgctggcctgcctactagacttcctgccggccggtgtgagccgggccaagatcacgccactgacactcaaggaggcatacgtgcagaagctggtgaaagtgtgcacagactcggaccgctggagcctcatctcactgtccaacaagagcggcaagaacgtggagctcaagtttgtggactcggtgagacgccagtttgaattcagcatagactccttccagatcatcctggactccctgttgctctttggccagtgctcgtccactcccatgtctgaggccttccacccaacggtcacaggcgaaagcctgtacggggacttcaccgaggccctggagcacctgcggcaccgtgtcatcgccacgcgcagtcccgaggagatccgaggtggtggcctcctcaagtactgccacctcctggtgcggggcttccggccccggcccagcaccgatgtgcgcgccctgcagcgctacatgtgctcccgcttcttcatcgactttccagacctggtggagcagcggcgcaccctagagcgctacctggaggcccacttcggtggggcagatgcagcccgccgttacgcctgcctggtgacactgcaccgggtggtcaacgagagcaccgtgtgcctcatgaaccacgagcgccgccagacgctggacctcattgccgcactggcgctgcaggcactggctgagcagggcccagctgccactgccgccctggcctggcgccctccaggcactgacggggttgtgccagccactgtcaattactacgtgacccccgtgcaacctctcctggctcacgcctatcccacctggctgccttgtaactgactcagaccctggccagaagggaagggactgggcctcacggggtggggtggggcctccaagagtgtgtggaggacatgaccagaggcgcagaatgtgccaggaggcccagcactgcagggttgggcctttgattgaacagaccagactttcccgagcacgaggcccctgtgggcttaatgccagcctggggctctcagcaggaggaccctttggttattgcatcacacttttggaccagcatgccggtggggtgcaggcgccatttgtcttggaagtcaatttccttcaggagacaaagcaagtttggggtggtagccttaatgcccagcaccttggattgattcccatggtctaagagggtctttttgactaaggccagcctgtggtgatcccagcagctttggagggcctgcagcccacacactgactgatacatggtatgttacagggacttgtcactttggatcaggctgggccactacagggcctgatgggccaacttgggtaatcactgggaggagggaaactgaggcccgaggcagatacctgggtttggggagggctgggtttagcccggttctctgaactacatacccccagctgtgaagccttcctcttgaggggttgaggtgggcagtatacaggagccaagcagcccagggtgggtcgcagcccaggccccttccagggtgccactcctttcccccttgtgttgcaaggagccctcctgcctgggagcttgttctttggaaggtgctgagcctgaatttgccacagtcaagtcaacgttcccaccccactggcttggttacagggctctcacatggggtaggggagccatactcccacccccttgcgtattcccctgggtttgttgatattttgcactcttaacacctgccaataaagacggtctacactgaa

SEQ ID NO: 132709 - DNA, 5751 bp, Homo sapiens
  Payload ID: 5929
  Gene Symbol: FAM46C
  Gene Name: family with sequence similarity 46, member C
  Uniprot ID: Q5VWP2
  ENST ID: ENST00000369448
  CDS Start-End: 248-1423
ccgaggggactggctccgccacgccccgcccctggctcccccgggagggcggctcaggggcggggacgggggcgtggtcccgccgtataagaacggagggggcggcggcgggacggctcactcggtgccgctgcctaggggctgtagaggtcgcgccgctcctgctggggcctgcccacgccaaggacctgcctctgtcgcctcctcttctattgcccagtttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaactttccaaccttggagataactctgaaggacatcgtccagaccgtccgcagtcggctggaggaggcaggcatcaaagtgcacgacgtccggctgaatggctccgcagctggccacgttttggtcaaagacaatggcttgggctgcaaagacctggacctaatcttccatgtggctcttccaacagaggcagaatttcagctggttagagatgtggttctgtgttcccttctgaacttcctgccagagggtgtgaacaagctcaaaatcagtccagtcactctgaaggaggcatatgtgcagaagctagtgaaggtttgcacggacactgaccgctggagcctgatctccctctccaacaagaacgggaagaacgtggagctgaagtttgtcgactccattcggcgtcagtttgagttcagtgtggactctttccaaatcatcctggattctttgcttttcttctatgactgttccaataatcccatctctgagcacttccaccccaccgtgattggggagagcatgtacggggactttgaggaagcttttgaccatctgcagaacagactgatcgccaccaagaacccagaagaaatcagaggcgggggacttctcaagtacagcaaccttcttgtgcgggacttcaggcccacagaccaggaagaaatcaaaactctagagcgctacatgtgctccaggttcttcatcgacttcccggacatccttgaacagcagaggaagttggagacttaccttcaaaaccacttcgctgaagaagagagaagcaagtacgactacctcatgatccttcgcagggtggtgaacgagagcaccgtgtgtctcatggggcatgaacgcaggcagactctgaacctcatctccctcctggccttgcgtgtgctggcggaacaaaacatcatccccagtgccaccaacgtcacctgttactaccagccggccccttacgtcagtgatggcaacttcagcaactactacgttgcccatcctccagtcacctacagccagccttaccctacctggctgccctgtaactaaccttgagacctgagggtttccacagtgggaaccccaatagggctagggctctcaggtaggggagcctccttctagatgtaggcatttggcttttaaaggggaactcagctctgattctgcttttttttttttttttcctttgtgtacccattggaatgggtctacagtgtatcatgagccaaccctcaaaggacccgtattacagtgccacgttggaaaacgctacaggaagcatgacctatccacatctttccaagatagacactaacatgtcatgtcccaaacattagcacgtgggggttgagctctgtgcagtaatcgagattgggagaatttgggcagcgcgtgagaagtgctaagctacttgttttctcacttgagcccgggtaggctgtgttggccctcacttgggattctcagcagttacatgaaagttgtgctgataatctcttctcttgtaccaattttagtcaggcagaaaatggtaaacatgagggtgctcttgtgacttaatttttgttcaagggactaaattgcttatgtttattccctgtcagcggagtggagaatgtcattcatcaataaaccaaagccaatagctggagaattgagatctggttgaaagtggtttatggtttacatgctgtactatcctgaggaattgcgagatattgctgaggggaaaaaaaaatgaccttttcttgaaatgtaacttgaaaacaaaataaaatgtggaacataatgtttaattagaattgtggtggtggtagtggaaggggataattgtaaataggaaacatgaatgttcatttttttctttaaagaattcttattaaatggctccctgccttttttttcttttttcctcatcagctctttcatggctgaattttgttttattcttcctaagactgaggattgtgctgagtccagagtcattgtggtaactgacatgagggtcttcccatgttttaactggaaacccactttggtcacattccaagtatgacacagctgttcttctggagtactttagctattttttgtttttgttcttttcgttttttttttttccaaaaatagtgacttccttctccaggtgtgtttgacagcaactcaattcaggaatttcggtagaactgagtgacctgtggaactgctttagaatctaacctgctgtcttcgtgctctgtgtgaaggggaagctggggggttagcatgaagtctggccttgtgtgcattggagcttccaaggcactttgaaatcattccagtatatttgggaagaattgagtgaatgagaatgctcttccttattctggtagatttgacttgtttataattctgcactttagaagaaaaacagtgttaatctgtagttgaaagaaagcttagtagatgagagagttctaggctactgtggctttttccagtagatttagatgagattatgtgttttgaaatgttttgtgggatcccttagaaagcatcacttcagggcagagacactcaatattgccagccagcttgggttctaaagtgatttaatcaaattcatgctcctgatcttttttttcccccttcctttggctatgaaaacccaaagcccggagtgattgttttctccttgctttaagcagtgaagttatcctaatgcaaaagagcttagtagaaaatgagtggtttacctttttttctaaaagtatattttcaagtttattctggaatgtgatgtcttggtcctcttaaaagcagatcagccatgactgaaactcaaggcttagctggtatctatgttgtgctacattaggtgactagaagccacttcttagtgtaatcagctcctgtttccctgtgagccttagttatattttaattcagtggctttgagtcaaggccggttctaattgaggggacccagtgtgcttcagtgttaagagtggggcaatgaagagtgaaccccaatgaagagtgatcccaactttggaaactatctggtcattcatgaccttaaaaagctgccatggtggtcaaatggcatgtgtttgcacaaaaatgaccgatgtgtttaaccaaagctttgaaatgtgatgaagccaccaacataagcacttgcctaacagaaatcagtatttcttctacttagaaggcttggggcccagggtaatgaggcaccagatgaagataagatctgcatcaaggaattaaatttccagtttgtccttggggttctttctgcttatgttttttcccccccatctggtaatagtcctcttctgagaatgaaaggaggcacagaagttgcgagaaagacccagtccccagtctttgccaccattgcaccatggttgtctcggagtcccttcacctgacctttttagtcagctcagatctttttgtagtttgagaatagacctattcaagagctatcagggttaaaagctgcactgaccaaagctgtacttttaaaacacaacccctgggctagtgatgtctctacttgctctatgagccttttgccagcctcagaataggcgaggtaaccttgaatttcagggccctggaaactctagctgaaacctgcctttcctaatgctcacacaagcaccaggtaccctgagcttatactgagtccagtggttcctattttatgtgtgtgtgtatgtgtgtgtgttgagtaacatgaaacttggcagtagcagagagcactgaagttcacatgcaagttctaatctaaagttaagcagtctcttatttgtttcgggactctgatttgactctttttctgatgctttcggcatgtctgcagcctgttctcctagcctgctgcttggagtcaggttgagcatcagtgagatgaagacagtaccttttcctctcacattggcagaatagcacgcactagatgcctgaccttgagctctagtctcccctttaaatcttaccttggcagtaacacattattcctcattcaataatttcaatgctgaaactgaactctattactaatgccttccaatcagagttcctgatggggatgcctgtgggatggcccacacctgggggacctggcagatggggtgagttgggtaaggaagatgatgcttagttcctgatagatgctacagatgtagtttggcatttcagtttttgtccagtttgattttcactggggtttgagtcacagcaagctgtgtatgaacttgtgttttgtggtgacacattaataatcaaattgctaaaaccctgaatctgcttattcttcagcttcacctctgcactaaccccttacccttatggtacgtcaggattttaactagtactgctttgttgactttgggaaatggtgccactcaaaagcaacttcctaacttgaggaataactcctttgtagtttactttctggtactggttggtgccttgtattgggatacagctatattcttagctcaaatgtcctctttttgagagcaaagtagttatccaatggtgagacgagaccctgacgctcatagaggccattccttcctgggtgtcggaccagggctctgtgtcagggaaaaccttctgggtggactttgtaagaatccagtttccaaggttagattcacatccttaatcttgcagagactagaatttcacagctcgctttggaacatattccaattcaaccagttaaaatcagaggaccaagtcgtgggggaggggggcggtgttgaggagaggtatttttaaagatctggcaacttttcaggattatttgtggagaactctaaggttaagatcaggaaataaaagactgtgtgtgtgtgtgtgtgtgcgtgtgtgtgttcaagtgcctaaatcttgtttacctatcactttaaaaaaataattgaagtgtaagctaaataaaatgcttggagttttgcctgggctagtgagagttggtgcaaattcttgtgtgtgtttgcataggaaggtgagatgaccatctactaaagaggaagtagctaaatacagatctgtgggtgtttttaaaaaaactcaacctatctggtgttttattttaatggataaaaatgtaatttttctaaggtagcaacttatttccaaattaatatagatgaaaaatagataccaattagactaaattgaaagctttttgttctatatttgcatagcctttgaaatatttcttagtgcctaggaggtctggggattcctctttcgtggtggtcactaaccttacttgatgcagataaaatcacttgtcaatgcaaaatgtgttagaacttgataaagctttgagtttgagaaataaaggtatatttaaaatttaaataaaa

SEQ ID NO: 132710 - DNA, 3011 bp, Homo sapiens
  Payload ID: 5930
  Gene Symbol: FAM46D
  Gene Name: family with sequence similarity 46, member D
  Uniprot ID: Q8NEK8
  ENST ID: ENST00000308293
  CDS Start-End: 240-1409
gaatgtgtggagatcaggtgatgcagaactctggtaaaggatgttagtcttcagagtaagactgttaaattcagcaaagtctactatcagaagacacgtttttctggttggtgtattactttattcagtgataatatgaaaattactatcttcactgaaggatctactgaataatcattttaactcaactatattgcattcttgaaagcaatcctttcaattgatctactgacttcacaatgtctgaaatcagattcaccaatctcacttgggatcaagttataacactggatcaagtgttagatgaagtaattccaattcatggaaaggggaatttccccacaatggaggtaaaaccaaaagacatcattcatgttgtgaaagatcaactcatagggcaaggaattattgttaaagatgccagattgaatggttccgtagcaagttacatacttgcaagccacaatggaatcagctataaggatctggacgttatttttggtgttgagcttccaggtaacgaagaatttcaggttgttaaagatgcagttctagactgtctacttgactttttaccaaaagatgtaaagaaggaaaagctctccccagatatcatgaaagacgcttacgtacagaaattggtcaaggtttgcaatgggcatgattgttggagtcttatctccctttcaaataacactgggaagaatttagaactaaaatttgtgagttcactcagacggcagtttgaatttagtgtagattcctttcaaattgttttggatcccatgttagacttctacagtgacaaaaatgccaagctaaccaaagaatcctatcctgttgtggtagctgaaagcatgtatggagacttccaggaagcaatgacacatttgcaacacaagctcatatgtaccaggaaacctgaagagattagaggtggtggccttctgaagtactgcagcttgctggttcatggcttcaagccagcctgtatgtcagaaatcaaaaacctagaacgttatatgtgctctagattctttattgattttcctcatatagaagaacagcaaaagaaaattgaatcatacctccacaaccatttcataggtgaaggaatgaccaagtatgactaccttatgaccttgcatggagttgtgaatgaaagcactgtttgcctcatgagttatgaaagaagacagattctccacctgatcaccatgatggctttgaaagtacttggagaactaaatattctacccaatacacaaaaggtaacttgcttttatcagcctgctccgtactttgcagctgaggcaaggtaccctatttatgtaatacctgagccaccccccgttagcttccagccataccacccactgcactttcgtggatcaaatggtatgagttaaaaaatacacatgcaaccatagaaactttgatttaattaaacaccatttaaaagcaagtttccaaatgtaaaattcaagatctgtttttatttttgtacagttaccaattattttcaattacagttgatggaatagtagttaccaactatttttgatcaattaagccatcatagtaaatacaatatctataaaccaaccactttaaatgtttttcaaacgttattgactagctataataactttcaaatgttgtgttccccttgaagtgattttcaaatcttttgactacttgtgactttcaaatttactgtgacaaatatattagagatgcctgcatctttgactataacataaaaggacagattcatgttttaaaattaagatgtacagtgaagtatcaaattttttatattcagtcagttcctttgttacatttagttctttttttctattgaacaataccatcaataaatgttcagtacttaacagaaatgcctaatttcaaaagcaacagattcagaagacattaaaaccctggacttttcaagcatttttttttgacaattaaattgggttggatacaaaaatcctactatagtttaaaggaatactggaaaaaaatggttctggaaagccctggacattagtaatttgtcatctatataataaaacatttagttaatttgtggatttgaataacaataccatacagctgtgcaactactactgagatcagatacagggttttttgcccctcaaaataagttaaaacgaatgaaaatgaccagctctgaatgtgaaagctttctatcatcatctactacaaagagactctaaatggcaaacaggaaaaaaacaggcagaggtttatagccatagcatttaccattttatggcttatttgaaaaacatctttatgttgagaaacattccatttcagtaagttaaaatattttcattgtaactaaatgaagcaggtttttcattttgcctttaccaaagatcattttctaacatgccactcaagtgcctcttcgtgtgaatttttgcgtaacactataatttattcaacaactgtatacctttacagtatatctaaatatatacttactacatcgagtatactgctagaaaaatctaccagtgggattaaaaatgtattttcttcccataatgaaaataattcatgaccaatattacctgaagtgtcagaagaggagctgtcttaaattaatatggatcaggccattggaaaacttcagtatttccacttggttatgattttttgtgagtttccatttcagtttttattgaccatcacgttttctatcacaacatgacctgacagttgtatcccgataatttgccagttatagactgtgcttatcttcactgtattacaatattggacagaagtacaccaaatacggcattttcaaataaccaatatttctgagatgttttataccacagcacaagtggccatcagtatatttttaaagaattatatatcacagaaccctgaggctttaaaacactatggacttaccactttcttgacaaagaatttgtaattacaataaaatatttagaaatgaaagg

SEQ ID NO: 132711 - DNA, 3106 bp, Homo sapiens
  Payload ID: 5930
  Gene Symbol: FAM46D
  Gene Name: family with sequence similarity 46, member D
  Uniprot ID: Q8NEK8
  ENST ID: ENST00000538312
  CDS Start-End: 335-1504
acgcgccccagctcccaccttgggtccttcgcctgcacccagtctaacctggcacctaaagatttcactctgtccttggcccctcaccattgtctcagagtttaagccttaacggatgaaggaaaaagattatttgtgaaaagaaattatctaacacttctcatctatctaactggagtttcactagctggagtttttctggttggtgtattactttattcagtgataatatgaaaattactatcttcactgaaggatctactgaataatcattttaactcaactatattgcattcttgaaagcaatcctttcaattgatctactgacttcacaatgtctgaaatcagattcaccaatctcacttgggatcaagttataacactggatcaagtgttagatgaagtaattccaattcatggaaaggggaatttccccacaatggaggtaaaaccaaaagacatcattcatgttgtgaaagatcaactcatagggcaaggaattattgttaaagatgccagattgaatggttccgtagcaagttacatacttgcaagccacaatggaatcagctataaggatctggacgttatttttggtgttgagcttccaggtaacgaagaatttcaggttgttaaagatgcagttctagactgtctacttgactttttaccaaaagatgtaaagaaggaaaagctctccccagatatcatgaaagacgcttacgtacagaaattggtcaaggtttgcaatgggcatgattgttggagtcttatctccctttcaaataacactgggaagaatttagaactaaaatttgtgagttcactcagacggcagtttgaatttagtgtagattcctttcaaattgttttggatcccatgttagacttctacagtgacaaaaatgccaagctaaccaaagaatcctatcctgttgtggtagctgaaagcatgtatggagacttccaggaagcaatgacacatttgcaacacaagctcatatgtaccaggaaacctgaagagattagaggtggtggccttctgaagtactgcagcttgctggttcatggcttcaagccagcctgtatgtcagaaatcaaaaacctagaacgttatatgtgctctagattctttattgattttcctcatatagaagaacagcaaaagaaaattgaatcatacctccacaaccatttcataggtgaaggaatgaccaagtatgactaccttatgaccttgcatggagttgtgaatgaaagcactgtttgcctcatgagttatgaaagaagacagattctccacctgatcaccatgatggctttgaaagtacttggagaactaaatattctacccaatacacaaaaggtaacttgcttttatcagcctgctccgtactttgcagctgaggcaaggtaccctatttatgtaatacctgagccaccccccgttagcttccagccataccacccactgcactttcgtggatcaaatggtatgagttaaaaaatacacatgcaaccatagaaactttgatttaattaaacaccatttaaaagcaagtttccaaatgtaaaattcaagatctgtttttatttttgtacagttaccaattattttcaattacagttgatggaatagtagttaccaactatttttgatcaattaagccatcatagtaaatacaatatctataaaccaaccactttaaatgtttttcaaacgttattgactagctataataactttcaaatgttgtgttccccttgaagtgattttcaaatcttttgactacttgtgactttcaaatttactgtgacaaatatattagagatgcctgcatctttgactataacataaaaggacagattcatgttttaaaattaagatgtacagtgaagtatcaaattttttatattcagtcagttcctttgttacatttagttctttttttctattgaacaataccatcaataaatgttcagtacttaacagaaatgcctaatttcaaaagcaacagattcagaagacattaaaaccctggacttttcaagcatttttttttgacaattaaattgggttggatacaaaaatcctactatagtttaaaggaatactggaaaaaaatggttctggaaagccctggacattagtaatttgtcatctatataataaaacatttagttaatttgtggatttgaataacaataccatacagctgtgcaactactactgagatcagatacagggttttttgcccctcaaaataagttaaaacgaatgaaaatgaccagctctgaatgtgaaagctttctatcatcatctactacaaagagactctaaatggcaaacaggaaaaaaacaggcagaggtttatagccatagcatttaccattttatggcttatttgaaaaacatctttatgttgagaaacattccatttcagtaagttaaaatattttcattgtaactaaatgaagcaggtttttcattttgcctttaccaaagatcattttctaacatgccactcaagtgcctcttcgtgtgaatttttgcgtaacactataatttattcaacaactgtatacctttacagtatatctaaatatatacttactacatcgagtatactgctagaaaaatctaccagtgggattaaaaatgtattttcttcccataatgaaaataattcatgaccaatattacctgaagtgtcagaagaggagctgtcttaaattaatatggatcaggccattggaaaacttcagtatttccacttggttatgattttttgtgagtttccatttcagtttttattgaccatcacgttttctatcacaacatgacctgacagttgtatcccgataatttgccagttatagactgtgcttatcttcactgtattacaatattggacagaagtacaccaaatacggcattttcaaataaccaatatttctgagatgttttataccacagcacaagtggccatcagtatatttttaaagaattatatatcacagaaccctgaggctttaaaacactatggacttaccactttcttgacaaagaatttgtaattacaataaaatatttagaaatgaaagg

SEQ ID NO: 132712 - DNA, 2556 bp, Homo sapiens
  Payload ID: 5931
  Gene Symbol: FAM47A
  Gene Name: family with sequence similarity 47, member A
  Uniprot ID: Q5JRC9
  ENST ID: ENST00000346193
  CDS Start-End: 34-2409
agctggagacgtggcaccacagcgagggccaccatgggggaccagaggctgcaggactggctgaggtccccgggcatggactccaagccctggtactgtaacaaacggccttccaagtgcttcgcgaagtgcaagcacaggcgcctgaggttcccacccatggacacccagaactgggtatttgtgaaggagggcatggacgacttccgctacggctgtccgtctcccgaagatactctcgtttgtcgccgtgacgagtttttactccccaaaatatctctcagaggtccccaagctgaccccaaaagcgggcagaaaaagctgctcaagaaagcggccctattttccaagctctctccagcccagctagcacggaaggcgttcgtagagcaagtggaagcccagctaatggccaagcatcccttggccatgtaccccaatctgggagaagatatgcctccagatctcctactacaggtgctgaaacacctggatcctgagagggagctggaggacgcttgggcttgttgtgagacccaggagaagacaacagaggtacccactgagcctggtaaacatccctgtggggaattctgcctgaagcctcccgagactccggtgtcccatctcctcccagagcctcccgagactggagtgtcccatctaagcccggagcctcccaagactccggtgtccagtctccgcccggagcctcctgagactggagtgtcccatctccgcccggagcctccagagactggagtgtcccatatccgcccggggcctcccatcactcgtcggagatccagtctcctacgacagctgctgaaactggattctgagaggaagctggaagacgcacgggctccttgtgagggccgggagaagacaactgacgaacccacagagcctggtaaatacccttgtgggaaattctgtcctcggcctttcgagactccactgtcccatctccgccaggagcctcccaagactccggtgtccagtctccgcccggagcctccggagactggagagtcccatctccgcctagagcattccaagactcgtcgggggtccagtctccgctcggagccttccgagactggagtgtcccgtctccgcctagcgcctcccaagactcgtcgggggtccagtctccacgcggagccttccaagactggagtgtcccatctcagcccggagcctcccaagactgaagtgtctcatctccacccagtgcctcccaagactggagtgtgccatctccgcctggaacctcccgacactagtcaggtgtccaatctcctactatacatactgaaagtgctggattctgggaggacgctgaaggacgtatgggatcgttgtgaggcccgggtgaagaaaactaaggaacccaccgagcctcataaatccccttgtggggaaccctgcctgcagcctcccgagactcaggtgtcccatccccacccggaacatcccaagacacgtcggaggtccagtctccactcgcagcctcccaagactcgtcggacgtccagtctccgctcggagcctcccaagactcgtcggacgtccagtctccgctcggagcctcccaagactcgtcggacgtccagtctcggtccggagcctcccaagactcgtcgagtgtccagtctccgcccggagcttcccaagagtcgtcgggtgtccagtctccacccggagcctcccaaagctccagagtcccatcaattctcggagcctcccaagattcgagcatcctacataaaagaactgcttcaggaagatacaccaagcacaaaagagtgcgtttctgactctcttcaatatagatacacatcggaaaaactccgtgaattcttcaagtgggctggagacctgggagctgatgaagaatccatcaggaatctgtttgactttacccccaagtacagagcaacccatgaggaccaaaagtttaagaaagtaaaggagtgttcctcagagctgaagtacagcatggagctagatgaaaaggatgaggacaaattcttctcacaggaaaaatactggggcaggaaattccacacgccatcgaattcttataccgcacagcgtgtgaagatgaagtatggagcatggtacctcaagcctaagttgtggaaaaagctaagaagtgatgaacctttgattgaccccaagctcttacttaaaaagcctgatgaacctgacgttcttgacgatctttatggaccaattgcctttaaggatttcattctaagcaagggctatgaaatgcctggcatcattcaaaggctgtttgccaggaggggatggacttatgactctgttaagactcctattcaacgtgcaatgatattttacaagtacaaagaaatcgtagaggcatcggaagaagattaggcagttttcaatttactactcaattgggtatttcttgctctcattttaatcatcaatcataatttatgatgactggccccgtggatgcacaactttggcaacatctgtaaattcaatacctaatgtttatcaatatttcttaatgaa

SEQ ID NO: 132713 - DNA, 2518 bp, Homo sapiens
  Payload ID: 5931
  Gene Symbol: FAM47A
  Gene Name: family with sequence similarity 47, member A
  ENST ID: ENST00000613251
  CDS Start-End: 37-2373
agaagctggagacgtggcaccacagcgagggccaccatgggggaccagaggctgcaggactggctgaggtccccgggcatggactccaagccctggtactgtaacaaacggccttccaagtgcttcgcgaagtgcaagcacaggcgcctgaggttcccacccatggacacccagaactgggtatttgtgaaggagggcatggacgacttccgctacggctgtccgtctcccgaagatactctcgtttgtcgccgtgacgagtttttactccccaaaatatctctcagaggtccccaagctgaccccaaaagcgggcagaaaaagctgctcaagaaagcggccctattttccaagctctctccagcccagctagcacggaaggcgttcgtagagcaagtggaagcccagctaatggccaagcatcccttggccatgtaccccaatctgggagaagatatgcctccagatctcctactacaggtgctgaaacacctggatcctgagagggagctggaggacgcttgggcttgttgtgagacccaggagaagacaacagaggtacccactgagcctggtaaacatccctgtggggaattctgcctgaagcctcccgagactccggtgtcccatctcctcccagagcctcccgagactggagtgtcccatctaagcccggagcctcccaagactccggtgtccagtctccgcccggagcctcctgagactggagtgtcccatctccgcccggagcctccagagactggagtgtcccatatccgcccggggcctcccatcactcgtcggagatccagtctcctacgacagctgctgaaactggattctgagaggaagctggaagacgcacgggctccttgtgagggccgggagaagacaactgacgaacccacagagcctggtaaatacccttgtgggaaattctgtcctcggcctttcgagactccactgtcccatctccgccaggagcctcccaagactccggtgtccagtctccgcccggagcctccggagactggagagtcccatctccgcctagagcattccaagactcgtcgggggtccagtctccgctcggagccttccgagactggagtgtcccgtctccgcctagcgcctcccaagactcgtcgggggtccagtctccacgcggagccttccaagactggagtgtcccatctcagcccggagcctcccaagactgaagtgtctcatctccacccagtgcctcccaagactggagtgtgccatctccgcctggaacctcccgacactagtcaggtgtccaatctcctactatacatactgaaagtgctggattctgggaggacgctgaaggacgtatgggatcgttgtgaggcccgggtgaagaaaactaaggaacccaccgagcctcataaatccccttgtggggaaccctgcctgcagcctcccgagactcaggtgtcccatccccacccggaacatcccaagacacgtcggaggtccagtctccactcgcagcctcccaagactcgtcggacgtccagtctccgctcggagcctcccaagactcgtcggacgtccagtctcggtccggagcctcccaagactcgtcgagtgtccagtctccgcccggagcttcccaagagtcgtcgggtgtccagtctccacccggagcctcccaaagctccagagtcccatcaattctcggagcctcccaagattcgagcatcctacataaaagaactgcttcaggaagatacaccaagcacaaaagagtgcgtttctgactctcttcaatatagatacacatcggaaaaactccgtgaattcttcaagtgggctggagacctgggagctgatgaagaatccatcaggaatctgtttgactttacccccaagtacagagcaacccatgaggaccaaaagtttaagaaagtaaaggagtgttcctcagagctgaagtacagcatggagctagatgaaaaggatgaggacaaattcttctcacaggaaaaatactggggcaggaaattccacacgccatcgaattcttataccgcacagcgtgtgaagatgaagtatggagcatggtacctcaagcctaagttgtggaaaaagctaagaagtgatgaacctttgattgaccccaagctcttacttaaaaagcctgatgaacctgacgttcttgacgatctttatggaccaattgcctttaaggatttcattctaagcaagggctatgaaatgcctggcatcattcaaaggctgtttgccaggaggggatggacttatgactctgttaagactcctattcaacgtgcaatgatattttacaagtacaaagaaatcgtagaggcatcggaagaagattaggcagttttcaatttactactcaattgggtatttcttgctctcattttaatcatcaatcataatttatgatgactggccccgtggatgcacaactttggcaacatctgtaaattcaatacctaatgtttatcaatatttcttaatg

SEQ ID NO: 132714 - DNA, 2120 bp, Homo sapiens
  Payload ID: 5932
  Gene Symbol: FAM47B
  Gene Name: family with sequence similarity 47, member B
  Uniprot ID: Q8NA70
  ENST ID: ENST00000329357
  CDS Start-End: 37-1974
agaagctggagaggtggcacaacagagagggccaccatgggggaccggaggccacaggaccggccaaggtcccaaggcatggactccaagccctggtactgtgacaaaccgccttccaagtacttcgcgaagcgcaagcacaggcgcctgaggttcccgcctgtggacacccagaactgggtatttgtgacggagggcatggacgacttccgctacgcctgtcagtctcctgaagatacgcttgtttgtcgccgtgacgagtttttactccccaaaatatctctcagaggtccccaagctgaccgcaaaagcaggaagaaaaagctgctcaagaaagcggccctattttccgagctctcgccagtacagccagcacggaaggcgttcgtagaggaagtggaagcccagctgatgaccaagcatcccttggccatgtaccccaatctgggaaaagatatgcctccagatctcctactacaggtgctgaaacagctggatcccgagaggaagctggaggacgcttgggctcgttgtgaggcccgggagaagacaaccgaggtacccaccgagtctggtaaatatccctgtggggaatcctgcccgcggcctcccgagactccggtgtcccgtctccgtcctcagcttcccaagactccggtgtccagtcgccgcccagagcctcccaagactcgggtgtccagtctccgcccagagcctcccaagactcgggtgtccagtctccacccggaacctccagagactcgcgcatctcatctccgcgtggatcctcccgagactggagtgtcccatctctgcccagagcctcccaagactctggtgtccagtgtccacccagagcctcctgatactggagcgtcccatctctgcccggagcctcccgagactcgcgtatctcatctccacccggagcctcctgagactggagtgtcccatctccgcccagagccttccaagactcaggtgtccagtctctgcccggagcctcccgaggctggagtgtcccatctctgcctggaacctcccaacactcatcgggtgtccagtttcctactacaggtgctgaaactggattctgagaagaagctggaagacgcacgggctcgttgtgagggccaggagatgacaaccgaggaactcaccaagcctggtaaataccatttttgggaatcctgtccgcggccttttgagagtcggatgccccatctccgcctggtgcttcccataactcgtcgaatggccagtctctgcctgaagcctcccaagactcgtcgggtgtccagtctctgcccggagcctaccaagaccggagcgtcccatctaaaagaactgtttcaggaagatacaccaagcacaatggagtgtgtttctgactctcttcaacgtagacacacatcgagaaaactccgtgacttcaagtgggctggagacctaggagttaatgaagaatccatcagcagtctgtttgactttacccctgagtgcagaacaaccgatcaagaccaaaagattaagaaggcaaacgagtgtgcttcaaggctgatgtacggcatggagctagacgacatggatgaggtcgaattcttacggataaaatactgggacaggagacgccgggcggcaccgcattcttatagtgcacagcgtgggaggataaggtatggaccatggtacttcgagcctaagttggggaaaaagctaagaagtgatgaacctttgattgaccccaagcccgtacttgaaaagcctgatgaacccgacattcttgacggtctttatggaccaattgcctttaaggatttcattctaagcaagggctacagaatgcctggcgtcattgaaaagctgtttgccaagaagggatggacttacgactctgttaagactcctattcaacgtgcagtgcaagtttacaagtacaaagaagacgtcacagatgcatcaaaagaagattagatggttttcaatttactgcttaattgggtatttcttgctctcattctaaacatcaatcagaatttatgatgactggccccgtgaatgtacaactttggcaacatctgtaaattcaatacccaatgcttataaatatgtcttaatga

SEQ ID NO: 132715 - DNA, 3270 bp, Homo sapiens
  Payload ID: 5933
  Gene Symbol: FAM47C
  Gene Name: family with sequence similarity 47, member C
  Uniprot ID: Q5HY64
  ENST ID: ENST00000358047
  CDS Start-End: 15-3122
cagcgagggccaccatgggggaccagaggccgcaggaccggcccagttccccgggcatggactccacgccctggtactgtgacaaaccgccttccaagtacttcgcgaagcgcaagcacaggcgcctgaggttcccgcctgtggacacccagaactgggtatttgtgacggagggcatggacgacttccgctacggctgtcagtctcctgaagatacgcttgtttgtcgccgtgacgagtttttactccccaaaatatctctcagaggtccccaagctgaccccaaaagcaggaagaaaaagctgctcaagaaagcggccctgttttccaagctctcgccagcacagccagcacggaaggcgttcgtagaggaagtggaagcccagctgatgaccaagcatcccttggccatgtaccccaatctgggagaagatatgcctccagatctcctactacaggtactgaaaccgctggaccctgagaggaagctggaggacgcaggctcttgtgagggccaggagaagacaactgacgaacccacggagcctggtaaatacccctgtggggaattctcccctcggcctcccgagactcgggtgtcctgtctccccccggagcctcccaagactccggtgtccagtctccgcccggagcctccagagactggagtgtcccatctccgcccacagcctcccaagactcaggtgtccagtctccacctggagcctccagagactggagtgtcccatctccgcccagagcctcccaagactcaggtgtccagtctccacctggagcctcccgagactggagtgtcccatctctacctggagcctcctgggactggagtgtctcatctctgcccagagcctcccaagactcgcgtatctcatctccatcgggagcctcctgagactggagtgcctgatctctgcctggagcctcccaagtcacgcgtatctcatctccgcccagagccttctgagactggagtgtcccatctccacccagagcctcccaagactctggtgtccagtctccacccagagcctcccgagactggagtgtcccatctctgcccggaacctccagagactcgcgtatctcctctccgccagctgcctcccgaggctggagtgtcccatctctgcccggaacctcccaagactcgcgtacctcctctccgcccagagacccccaagaatggagtgtctcctctcttcccggagcctcccaagactcgcatatctaatctccgctcggagcctcccaagattggagtgtcccatctctgcctggagcctcccaagactcgcggatctcatctccgcccggaacctcctgagactggagtgtcccatctccgcccagagcctcccaagactcgggtgtccagtctccacctggagcctcctgagactggagtgtcccatctctgcccggagcctccagagaaggacgtatctcatctccgcccagagcctcccgacactggagtgtcccatctctgcccagagccccccaagacacgcgtatctcatctccgcccagagccttctgagactggagtgtcccatctccgcccagagcctcccaagattctggtgtccagtctccaccaggcacctcctgagagtagcgtatctcatctccgcccagagcctcctgagactggagtgtcccatctccgcccagagcctcccaagactcggatgtacagtctccgcccggagcctcccgatactggagtgtcccatctctgcccagagcctcccaagactcgggtgtccagtctccccccggagccccccgagactggagtgtcccatctctgcccggagcctccagagactcgcgtatctcatctccgcccagagcctcctgagactggagtgtcccatctccgcccagagcctcccaagactcggatgtacagtctccgcccggagcctcccaatactggagtgtcccatctctgcccagagcctcccaagactcgggtgtccagtctccccccggagccccccgagactggagtgtcccatctctgcccggagcctccagagactcgcgtatctcatctccgcccagagcctcctgagactggagtgtcccgtctccacccagagcctcccaagactcgggtgtccagtctccacgcggagcctcctgagagtcgcgtatctcatctctgcccggagcctcctgagactggagtgtcccatctccgcccagagcctcccaagcctcgggtttccagtctccgcccagagcctcttgagactcgcgtatctcatctccgcccggagcctcctgagactggagtgtcccatctccacccagagcttcccaagcctcgggtatccagtctccacctggagcctcccaagactcgtcgagtgtccagtctccgcctggagcctcccaagactggtcgggtgtccagtctctgcccggagcctaccaagaccggagcgtcccatctaaaagaactgtttcaggaaggtacatcaagcacaatggagtgtgtttctgactctcttcaacgtagacacacatcgagaaaactccgtgacttcaagtgggctggagacctaggagttaatgaagaatccatcagcagtctgtttgactttacccctgagtgcagagcaacctatcaagaccaaaagaataagaaggcaaacgagtgttcctcagggctgaagtacagcatggagctagacgaaatggatgaggtcaaattcttctcacaggaaaaagacttggacgggaaaatccagaatgcaccaaattctcatagtgcacagcatgtgaagatggggtatggagcatggtacctcaagcctaagttggggaaaaagctaagaagtgatgaacctttgattgaccccaagctcgtacttgaaaagcctgatgaacccgacattcttgacggtctttatggaccaatcgcctttaaggatttcattctaagcaagggctatgaaatgcctggcatcattcaaaggctgtttgccaggaggggatggacttatgactctgttaagactcctattcaacgtgcaatgcaagtttacaagtacaaagaagacgtcacagatgcatcggaagaagattagatggttttgaatttactagttaattgggtatttcttgctctcattttaaacatcagtcagaatttatgatgactggccccaggaatgtacaacgttggcaacatctgtaaattcaatacctaatgtttataaatatttcttaatgacc

SEQ ID NO: 132716 - DNA, 1484 bp, Homo sapiens
  Payload ID: 5934
  Gene Symbol: FAM47E
  Gene Name: family with sequence similarity 47, member E
  Uniprot ID: Q6ZV65
  ENST ID: ENST00000424749
  CDS Start-End: 7-1188
gccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacaggaggagttacttgcagaccttcacggaacagttgcctttaaggatttcattctaagcaggggctacaggacgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaa

SEQ ID NO: 132717 - DNA, 1624 bp, Homo sapiens
  Payload ID: 5934
  Gene Symbol: FAM47E
  Gene Name: family with sequence similarity 47, member E
  Uniprot ID: Q6ZV65
  ENST ID: ENST00000510197
  CDS Start-End: 415-1302
agcgccctgcaccgcaggcccagcgctcgccccaccgaaattgccgaacctggttcacacactcatttactcattccgcagataggtctgagggcctcccatgggccacgcgctggggattcaaggtggctgggacattcccctgctctagaggcgctcgcaagttagcggggacaccgttaccgcaattacaacacaatgtagcaagtgcttctaccaggtgcctgctgagatcatgccagcaagcatgttctgcctggatgacctagggccccacattgaactggggcctgggggatgcataagtttgtcacgtaaggggcatgtgcaagaatggaagatgtgcaaaaaagggaggaggaggcatttcacggagaaggaaacggagtggaagcagcctgaggccctcatccaatgcagatgtctgtgccgtgcgtcttgtccagcctgcagaaccatgagccaaataaacctcttttcactacccaatctcagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacaggaggagttacttgcagaccttcacggaacagttgcctttaaggatttcattctaagcaggggctacaggacgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaaaaataaataaaggcataaataaaaac

SEQ ID NO: 132718 - DNA, 571 bp, Homo sapiens
  Payload ID: 5934
  Gene Symbol: FAM47E
  Gene Name: family with sequence similarity 47, member E
  ENST ID: ENST00000512895
  CDS Start-End: 172-571
atttactcattccgcagataggtctgagggcctcccatgggccacgcgctggggattcaaggtggctgggacattcccctgctctagaggcgctcgcaagttagcggggacaccgttaccgcaattacaacacaatgtagcaagtgcttctaccaggtgcctgctgagatcatgccagcaagcatgttctgcctggatgacctagggccccacattgaactggggcctgggggatgcataagtttgtcacgtaaggggcatgtgcaagaatggaagatgtgcaaaaaagggaggaggaggcatttcacggagaaggaaacgctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatg

SEQ ID NO: 132719 - DNA, 463 bp, Homo sapiens
  Payload ID: 5934
  Gene Symbol: FAM47E
  Gene Name: family with sequence similarity 47, member E
  ENST ID: ENST00000606246
  CDS Start-End: 1-374
acgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttgtaagttagtggtaatatttaaacctacttttaaatgtcaagctcaaagttgcttttattaaaaaacagtattggataaaatctaagtcaaatcctca

SEQ ID NO: 132720 - DNA, 4670 bp, Homo sapiens
  Payload ID: 5935
  Gene Symbol: FAM49A
  Gene Name: family with sequence similarity 49, member A
  Uniprot ID: Q9H0Q0
  ENST ID: ENST00000381323
  CDS Start-End: 222-1193
agaggcgtactcggcggcggcggagcgggcggcagagcagggcggcggcgactcgcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacatctataacgataaaaaattcctaattgtttgtggtagtattttaattctagatgtgttatctctctgggaagtatagtttatagaaacacaaaatatttgatttcctgtgtcggctcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctcctgtatttttttcagttagtgggagagcagcagaaatagatagatgtgctgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctgtacatcagagcttagttcgaatggaatcatgaaaatctctgattctgacctcctaaggaaaaatgaaacccagaggatgtggtcatacaggatggctcccatgtgggcctagaacccaggatgcttcactcttgactccatgctcttccttttataccatgtggctgtgaatacatactatgggatgggattcaacccttctaagtaaatcctcagtctggtctatattgttacttgcctgtttccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggatttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatgactgagatatttatttttgggaaagcaacgaggtaaaaattatgtttctcagatgcactgctactttggcgttattactgtgttctcagaaactcgttgtgcaccactaggaattagtagtagaaaaaaaaaaacaataacaaaaaaaaaaaacaactggaaatggatgtcttcacattaggggtggagtattaacaaccagaaagaaagtttggatattaccttttaactactagttaacatcatgcttgatcaacatttgctcctagttatcaccattaaattaagaccttaatggtaaactgaggttactgatgcatcatcacatttaagtaaaaataatttcatgttttccccaaagaaaaattaagcctcccaatcttaggatccaattgtgcagtagaattcagagacttctcattcaatcttgtatcctatgcagctacaaatattttttaaatgttagtaataaacattggaattttgtcttaaagagttcaaaaccttggaacccagttttctcactacgtctataaaggccattacagacccaaggctgttttgcagttttcatatgttgtttgctgaagtcattgtaattttttttgcctgctttgcctttttttctacaggagttttgagtgtgaaatgaaaattaaagtttggtacatatatttaaaaa

SEQ ID NO: 132721 - DNA, 1386 bp, Homo sapiens
  Payload ID: 5935
  Gene Symbol: FAM49A
  Gene Name: family with sequence similarity 49, member A
  Uniprot ID: Q9H0Q0
  ENST ID: ENST00000406434
  CDS Start-End: 415-1386
gtactcggcggcggcggagcgggcggcagagcagggcggcggcgactcgcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggcccagtgtaaggaatcatggtcaggagtcatgaaaaaaatgccaacacactgagatggccacacatcttcactcttgcactagtttttggtgttatcttctgctatcctgtcttgaagctctttttcagctagataccttgacttttctgaaaaactaaaaccagaagcatttcacgaagctaagcacaggacagaaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtag

SEQ ID NO: 132722 - DNA, 579 bp, Homo sapiens
  Payload ID: 5935
  Gene Symbol: FAM49A
  Gene Name: family with sequence similarity 49, member A
  ENST ID: ENST00000451689
  CDS Start-End: 317-579
ttaatagggtgggcagaaagggactgggagcgagactgggttcagaatctcaagtaatttggagtgtgcctagggattgggatgatttggctgggcattaatttgaagatccttttgtgacacgcctggcccctcagccacagtcaaaagcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgag

SEQ ID NO: 132723 - DNA, 544 bp, Homo sapiens
  Payload ID: 5935
  Gene Symbol: FAM49A
  Gene Name: family with sequence similarity 49, member A
  ENST ID: ENST00000445605
  CDS Start-End: 263-544
agaaggggcaggggcgaccgtgctggggcgggtccgcaccagctcctgggagcagagagcagagccgggcaaagagatggggttgtccaggctaggcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgag

SEQ ID NO: 132724 - DNA, 2024 bp, Homo sapiens
  Payload ID: 5936
  Gene Symbol: FAM49B
  Gene Name: family with sequence similarity 49, member B
  Uniprot ID: Q9NUQ9
  ENST ID: ENST00000401979
  CDS Start-End: 378-1352
aaacggcggcggcggcggcaccggaggctccgaggctcctgcgctcccgcgccgcgctcccctcgcccgcccgggccgccaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 132725 - DNA, 421 bp, Homo sapiens
  Payload ID: 5936
  Gene Symbol: FAM49B
  Gene Name: family with sequence similarity 49, member B
  ENST ID: ENST00000518167
  CDS Start-End: 227-421
ccgccaacccggaaacggcggcggcggcggcaccggaggctccgaggctcctgcgctcccgcgccgcgctcccctcgcccgcccgggccgccagatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagag

SEQ ID NO: 132726 - DNA, 2196 bp, Homo sapiens
  Payload ID: 5936
  Gene Symbol: FAM49B
  Gene Name: family with sequence similarity 49, member B
  Uniprot ID: Q9NUQ9
  ENST ID: ENST00000522746
  CDS Start-End: 550-1524
ggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 132727 - DNA, 699 bp, Homo sapiens
  Payload ID: 5936
  Gene Symbol: FAM49B
  Gene Name: family with sequence similarity 49, member B
  ENST ID: ENST00000520204
  CDS Start-End: 399-699
tgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaagaatattagcactattggaatacttaaagaatttttcattataaggccattaatgaaacttgtcttgggagaattttgagaagaattagagcaacagttgtgccattgtgtacaggaaaaccacatttcacctctaggtcctacatatcaacaccttgagaacccgttttgctgtctgccagagcacagtctgggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttag

SEQ ID NO: 132728 - DNA, 581 bp, Homo sapiens
  Payload ID: 5936
  Gene Symbol: FAM49B
  Gene Name: family with sequence similarity 49, member B
  ENST ID: ENST00000523993
  CDS Start-End: 302-581
aggcccagtaagtatctgcgggagggctgaatgggtgcgtggacagcattcctctcactgaccccgctgcgaggtgagccaggcaggggctgtcaccattcctgaagtccaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaatttt

SEQ ID NO: 132729 - DNA, 1902 bp, Homo sapiens
  Payload ID: 5936
  Gene Symbol: FAM49B
  Gene Name: family with sequence similarity 49, member B
  Uniprot ID: Q9NUQ9
  ENST ID: ENST00000519110
  CDS Start-End: 256-1230
ggggaggcgcgtcgcgaggcgagcgtcctccttttgtgcgagcgccggcggctcggcttctcgaaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 132730 - DNA, 3798 bp, Homo sapiens
  Payload ID: 5936
  Gene Symbol: FAM49B
  Gene Name: family with sequence similarity 49, member B
  Uniprot ID: Q9NUQ9
  ENST ID: ENST00000519824
  CDS Start-End: 275-1249
gtcgttaccctgtacatccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaagtgtggcttggtttactgatgttttgtttttaggcttctgaagttttccccatgtatgtttttatggaatgcatatatacattacatgattttttcttcttttaggggagagccgggtcttttcattagaattttgatcattgtctatgtatatacttttaattgcctttaaaattttgctaagtatattaagaccagtgatcttttcattaactggacttttattcttgatttactcttgtatggatgtagtaatggaaggaaaaccgcatccttgcttgattctccatttccaggggagcgggtagcaacatgaaggcagagtagccctttaatcatgggaagagagtgattataagagggacttcccaggagaaaagcagaggccatgatctcactagtggtagaaaactaacaggtttcagtttaagatcataaaacctaaatcatgaaatctaaatctcatggttggaacaaactacttaaaggttgtctagttcaaccatgccagtgttttaaatatttaggaatatccgaggtataatacaattaaaatgtttaaccatggaagagaatcacagaggcttccatcagacccttctggattaatagggccagatcatggcacacacagcttctcaagatcacatccctgctgatctctctggccctcctgatcactgctcccccacttcacaccctgtcctgcagccaggccctactgcttgctgttcacaaattgttccatgtgatgtcacttccttagctctggtctggctggtccctgaacctgacattcccttcctccccttgtgaccctctaatgaacgccaactttcatctttgaagggttagcttctattacctccttcatgaagccttctggataacattggccatatccttctaggcatcttctaagaatagtgtaataggctgaatagtggcccccaggagatacattcactgggaatctccacgtgtgacattatttggaaaaagtttttgcagatgaaatcaaggacctggaaatgagatcaacctgtagtagggtgggccctaaattcaatgactagctcttagaaaagaaggggaaatagacacacagagctgaaggccatgggaagatggaggcagagattagagcaatgcatctatgagccaaagaaccctaagaattggaggaagtcactagaagctaggaaaacaggcatgtcacagattctccctcagagtctcgagaaggaaccaaccctaccaatatcttgatttcagacatctggcctccaggattgtgagggaataaatttctgttgttttaagccatgcagtttgtggtattttggtacagcagccttaagaatctgatacatgtatctcgtaaaacacctctgatacttacctgcgcttgtggctgtgttttctgatactatgagagccgtagtatctggataccggagagtctgcgaacttgagagaagggccgtgtctgattttccttcagtgtcccaaggaaggatcttgcacagtacccagatttggagaggtgccaagtgaatgcttcggtggactgaatgaatacaaatcaaaaataatgatgcagcgggaatggatgcagtaagattgctgtggcctatgcagttcacacagttcacactctgcatgttgaggagtaagtggacagatctcttaagcccaggggctagcaaaccggtctgtgggccaatttactcaccgtctgtttttgtacagcttgtgagctaaaaatggtttttaaaaaggttgaatacaatcaaaagaataatattttgtggcatgagaaaagcatatgaaattcaaattttagtgttcataaataaaattttattggaacctaa

SEQ ID NO: 132731 - DNA, 2021 bp, Homo sapiens
  Payload ID: 5936
  Gene Symbol: FAM49B
  Gene Name: family with sequence similarity 49, member B
  Uniprot ID: Q9NUQ9
  ENST ID: ENST00000519540
  CDS Start-End: 402-1376
cggcgccctcacttcctggcattccctcctccccctccccgtcgttaccctgtacatccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataa

SEQ ID NO: 132732 - DNA, 573 bp, Homo sapiens
  Payload ID: 5936
  Gene Symbol: FAM49B
  Gene Name: family with sequence similarity 49, member B
  ENST ID: ENST00000519020
  CDS Start-End: 370-573
ttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaagttcctcctaacaggaacccagctggcaaagatgtctgggaaatgtcatttgcattctcagccccagcagtgcagaaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccag

SEQ ID NO: 132733 - DNA, 1968 bp, Homo sapiens
  Payload ID: 5936
  Gene Symbol: FAM49B
  Gene Name: family with sequence similarity 49, member B
  Uniprot ID: Q9NUQ9
  ENST ID: ENST00000523509
  CDS Start-End: 322-1296
ccgcgccgcgctcccctcgcccgcccgggccgccaggagaagaaactgaggcctggaatttgattaactcattcaaggttacccagttgatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 132734 - DNA, 561 bp, Homo sapiens
  Payload ID: 5936
  Gene Symbol: FAM49B
  Gene Name: family with sequence similarity 49, member B
  ENST ID: ENST00000519070
  CDS Start-End: 419-561
ttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaagg

SEQ ID NO: 132735 - DNA, 1647 bp, Homo sapiens
  Payload ID: 5936
  Gene Symbol: FAM49B
  Gene Name: family with sequence similarity 49, member B
  Uniprot ID: Q9NUQ9
  ENST ID: ENST00000522250
  CDS Start-End: 453-989
tccccctagcgccgctgaggagccgcctctgcggctccaggagggcgcaggagcgggactgagagcgcctggaggctcgagcggaggatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagc

SEQ ID NO: 132736 - DNA, 579 bp, Homo sapiens
  Payload ID: 5936
  Gene Symbol: FAM49B
  Gene Name: family with sequence similarity 49, member B
  ENST ID: ENST00000520254
  CDS Start-End: 344-579
catccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggc

SEQ ID NO: 132737 - DNA, 367 bp, Homo sapiens
  Payload ID: 5936
  Gene Symbol: FAM49B
  Gene Name: family with sequence similarity 49, member B
  ENST ID: ENST00000522361
  CDS Start-End: 231-367
aaacggcggcggcggcggcaccggaggctccgaggctcctgcgctcccgcgccgcgctcccctcgcccgcccgggccgccaggagaagaaactgaggcctggaatttgattaactcattcaaggttacccagttgggtggtgaaaacagtaggtattctgaaccaaccttgcacttctcagatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgc

SEQ ID NO: 132738 - DNA, 1700 bp, Homo sapiens
  Payload ID: 5936
  Gene Symbol: FAM49B
  Gene Name: family with sequence similarity 49, member B
  Uniprot ID: Q9NUQ9
  ENST ID: ENST00000522941
  CDS Start-End: 525-1061
ttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttga

SEQ ID NO: 132739 - DNA, 548 bp, Homo sapiens
  Payload ID: 5936
  Gene Symbol: FAM49B
  Gene Name: family with sequence similarity 49, member B
  ENST ID: ENST00000517672
  CDS Start-End: 360-548
ttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaagaatattagcactattggaatacttaaagaatttttcattataaggccattaatgaaacttgtcttgggagaattttgagaagaattagagcaacagttgtgccattgtgtacaggaaaaccacatttcacctctaggtcctacatatcaacaccttgagaacccgttttgctgtctgccagagcacagtctgggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaata

SEQ ID NO: 132740 - DNA, 1817 bp, Homo sapiens
  Payload ID: 5936
  Gene Symbol: FAM49B
  Gene Name: family with sequence similarity 49, member B
  Uniprot ID: Q9NUQ9
  ENST ID: ENST00000517654
  CDS Start-End: 185-1159
aaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagc

SEQ ID NO: 132741 - DNA, 574 bp, Homo sapiens
  Payload ID: 5936
  Gene Symbol: FAM49B
  Gene Name: family with sequence similarity 49, member B
  ENST ID: ENST00000518283
  CDS Start-End: 279-574
gtgcgagcgccggcggctcggcttctcgaaggagaagaaactgaggcctggaatttgattaactcattcaaggttacccagttgataactgcagcattggactagaggtggagagagtggtactgggggagtggtgaagcaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagag

SEQ ID NO: 132742 - DNA, 696 bp, Homo sapiens
  Payload ID: 5936
  Gene Symbol: FAM49B
  Gene Name: family with sequence similarity 49, member B
  ENST ID: ENST00000519142
  CDS Start-End: 231-696
gaaactgaggcctggaatttgattaactcattcaaggttacccagttgggtggtgaaaacagtaggtattctgaaccaaccttgcacttctcaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaaggtagaattatctattggccctgattgtt

SEQ ID NO: 132743 - DNA, 750 bp, Homo sapiens
  Payload ID: 5936
  Gene Symbol: FAM49B
  Gene Name: family with sequence similarity 49, member B
  ENST ID: ENST00000615041
  CDS Start-End: 1-654
atgcagaaggcatcttggaggacttgcagtcatacagaggagctggccacgaaatacgagagggcaatccagcatccagcagatgagaagttgcaagagaaggcatggggtgcagttgttccactagtaggcaaagaaattttacgaattttctcagaggttagaagcagcattaagaggtcttctgggagccttaacaagtaccccatattctcccacccagcatctagagcgagacaggctcttgctaaacagtttgcagaaattcttcatttcacactccggtttgatgaactcaagatgacaaatcctgccatacagaatgatttcagctattatagaagaacattgagtcgtatgaggattacaatgtaccgggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattccttgagggtaatggtgggtgtcataatactctatgaccacgtacatccagtgggagcatttgctaaaacttccaaaattgatatgaaaggttgtatcaaagttcttaaggaccaacctcctaatagtgtgga

SEQ ID NO: 132744 - DNA, 1240 bp, Homo sapiens
  Payload ID: 5937
  Gene Symbol: FAM50A
  Gene Name: family with sequence similarity 50, member A
  ENST ID: ENST00000158526
  CDS Start-End: 461-1240
ccggggcaggcccctggctcgctgacttccagcagggcacacagaagcaagccagcgacagtctcatctgtgaaatgggcctggagccgggcgttctccgaggctgaggccactagctgatgaccggcctccggcaggagggagccgagccagtgtttctgttgggaggcacggcggggacgggcctctcgtcgcctcgcctgggcacccagcgtcctggctctggcccctcggccctcagagccaggcctctgccccctcggccctcagagccaggcctctgccctggtcctatggacaccgggcagggcggttcgtctccccctggagaggcggggaggcctgagccagacctggcaagtccactggccaggaggctccttccagaaccccttgcacctgtgaggcaggcacgaccctcccgggtgccagcggttcacccactgcttccgagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgag

SEQ ID NO: 132745 - DNA, 1352 bp, Homo sapiens
  Payload ID: 5937
  Gene Symbol: FAM50A
  Gene Name: family with sequence similarity 50, member A
  Uniprot ID: Q14320
  ENST ID: ENST00000393600
  CDS Start-End: 111-1130
cacggcgcgggcgtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 132746 - DNA, 1628 bp, Homo sapiens
  Payload ID: 5938
  Gene Symbol: FAM50B
  Gene Name: family with sequence similarity 50, member B
  Uniprot ID: Q9Y247
  ENST ID: ENST00000380272
  CDS Start-End: 123-1100
ggctgtcgcgagagcccggggcgagtgggcctctgctcgtgggtggttctcgtggaggtcagctcccgcgtgtctccgctcgacagggtgcttgggcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttatta

SEQ ID NO: 132747 - DNA, 1932 bp, Homo sapiens
  Payload ID: 5938
  Gene Symbol: FAM50B
  Gene Name: family with sequence similarity 50, member B
  Uniprot ID: Q9Y247
  ENST ID: ENST00000380274
  CDS Start-End: 427-1404
acggctgtcgcgagagcccggggcgagtgggcctctgctcgtgggtggttctcgtggaggtcagctcccgcgtgtctccgctcgacagggtgcttgggcaggtaagggtccgctcagtagcccaaccctctctgtatgcagctccccaaattcagcgctgcgctcaggcatggcagccacccgttacgtggggccgttcgcatttgcatttattgaggtcaaataaaatgctggaaattggtgcctggtgacactgtcaggttggtggttaccctagcaggtcggcccagcccctgaacgcttccatcactgccgaaagccctgtgaggaggcgcagagctgagcattccccgccgttgcgtgggcccccctctacctgccgcgtttttcctctttgctgcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttatta

SEQ ID NO: 132748 - DNA, 2802 bp, Homo sapiens
  Payload ID: 5939
  Gene Symbol: FAM53A
  Gene Name: family with sequence similarity 53, member A
  Uniprot ID: Q6NSI3
  ENST ID: ENST00000308132
  CDS Start-End: 194-1390
tcgctccgcacccccgcggccgcgctcaggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaagggcgttctattaaacatgaatctgcaaacagattaacatgcgtctgtgttccccacgaaaggcctgctgtgcagggcgccttgtgtgctttagttgctaggaaaccccgggcgttggtggtcagagtcccactggccccgtgtgtccccccctcccgacgggtcacggtgcttggggcttgcgcatgggcatctgtgcccatgaaccttgtcacccacgtgccagtgaaccgccagcttgtggccgcctggttttccaccggtggcagtgatggcctttggggcagaccaaggtgccatgagtccctgcttcccgtggcctgggagggcccttgcaccttcaggtggggtgtagtgccagacctctgggaaggctgtcctgccggcagcacccgtcagcacccactctgtgaatttaatacaaggcctttgctttgtgcatacgacttctgattaattttcgtttccaccatctgaagtgggcctggctgcgcctcaggcctctggtctctggctcagaaccagacaaggcaagggatttcctgtttttcattcttgcacttttaataaaatcgtaggggtttcgagtttgcgatagcaaaagaaaacattaa

SEQ ID NO: 132749 - DNA, 558 bp, Homo sapiens
  Payload ID: 5939
  Gene Symbol: FAM53A
  Gene Name: family with sequence similarity 53, member A
  ENST ID: ENST00000463238
  CDS Start-End: 235-558
gtcgccctgagcgagcggggcctgggcggccggcagtcttctcgctccgcacccccgcggccgcgctcaggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagc

SEQ ID NO: 132750 - DNA, 2159 bp, Homo sapiens
  Payload ID: 5939
  Gene Symbol: FAM53A
  Gene Name: family with sequence similarity 53, member A
  Uniprot ID: Q6NSI3
  ENST ID: ENST00000461064
  CDS Start-End: 165-1361
gcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaa

SEQ ID NO: 132751 - DNA, 2776 bp, Homo sapiens
  Payload ID: 5939
  Gene Symbol: FAM53A
  Gene Name: family with sequence similarity 53, member A
  ENST ID: ENST00000489363
  CDS Start-End: 599-1681
cgggcggtcgtgggcgcggggccctgcgctccgagctgggcgcgtggactacgtccccctgcctccgccgtctgcgccgcccgtcgaggcgacttttccgcacgaggcgaggcccgccctggtggccccgcgccgtggttcggtggcgcgagaggcggggagtcgccgtggtaaacggggccttggggcgtcccgaaggggacccagacgcgggaggccagacttccccggcgacccgaggaggggacttgcggcggattccgaagccgctttttctgcgtagcctgggggtgtaaatcgccgagattctcctgtgtggagaaggcgccggtgcccgcccgctgctgccggactctagaggggtgtctttttccgttaatctgagcgcagtcgcggagcccctgtttcccacgcagcctgtgttaagtggcctcgcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagccgcacagctgtgcccgcgagtgcgagtcccgcgtccgaggcctcggcgtgagcttacagcatctgtcgggtccgagcagtcagtccagagggtcgactctgaatgaaaacaaaacgccgtggtttgaaatggaaggaaacctggcccctgaagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaagggcgttctattaaacatgaatctgcaaa

SEQ ID NO: 132752 - DNA, 628 bp, Homo sapiens
  Payload ID: 5939
  Gene Symbol: FAM53A
  Gene Name: family with sequence similarity 53, member A
  ENST ID: ENST00000489029
  CDS Start-End: 1-470
ggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccaggttgcctcacggactgtttcaccaagtatgttgccatgacatagcacggccctccatcttcccatcttcacggcatctgacagccgtctcctcactggtcggctctatgccaagcattcgtgacacacgtcagttctgttgtggtggcaccatcgcagcgacttctctcttggtgaaggagttgctgctgctcacca

SEQ ID NO: 132753 - DNA, 2086 bp, Homo sapiens
  Payload ID: 5939
  Gene Symbol: FAM53A
  Gene Name: family with sequence similarity 53, member A
  Uniprot ID: Q6NSI3
  ENST ID: ENST00000472884
  CDS Start-End: 199-1395
ggttcggtggcgcgagaggcggggagtcgccgtggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttgg

SEQ ID NO: 132754 - DNA, 1568 bp, Homo sapiens
  Payload ID: 5940
  Gene Symbol: FAM53B
  Gene Name: family with sequence similarity 53, member B
  Uniprot ID: Q14153
  ENST ID: ENST00000280780
  CDS Start-End: 432-1349
cacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagatagccccatgaggaaggcacatcgttatccattttacaggcggtggctgagtcttagaggaagcagtccagtgaaaccagaactcaagccacatatataatttaaaattcctagtagccagttattaagagaagaaagtgaaatgactttgaatagtatatttaacccagtatttccaaaatactatcatttccacatgtcatcgatgtaagtaaatcatgaatgcacta

SEQ ID NO: 132755 - DNA, 5431 bp, Homo sapiens
  Payload ID: 5940
  Gene Symbol: FAM53B
  Gene Name: family with sequence similarity 53, member B
  Uniprot ID: Q14153
  ENST ID: ENST00000337318
  CDS Start-End: 213-1481
ggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaatacccaa

SEQ ID NO: 132756 - DNA, 3557 bp, Homo sapiens
  Payload ID: 5940
  Gene Symbol: FAM53B
  Gene Name: family with sequence similarity 53, member B
  Uniprot ID: Q14153
  ENST ID: ENST00000392754
  CDS Start-End: 718-1986
gtactgtacttaggacgatggtgaacaaagaaaagctctttgcagcgtttgatgaatgggattctgcctcctataggccacactccgagtcttccatacggtacaatctccggactcggtggtgttaggaaagtggcccccggaatggcttgcattccgggtctgggatcctggggtgggcatttgtgccgtcgccttcgccgccgcgctcgccttgcaggagcgggtgcagatggagccaggctgacggttgttcaacaggaacaaatgtttgttcaattgttggatggtggagaaaagggactgtttcctattgactgctgcaggagttggaatggcattgtttattggcctgggaagccaggcaagcgtcttgtgctgcttacaacatattagcagacttccaaatgacatgctagcatatgtgttcccagcagtccccaccggctggcagggagattcctccttgctccagatcctggactcgtttaaaagatgccacctggtttgaggacttgggaaggaatggagtcagccgaccagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttggg

SEQ ID NO: 132757 - DNA, 4377 bp, Homo sapiens
  Payload ID: 5941
  Gene Symbol: FAM53C
  Gene Name: family with sequence similarity 53, member C
  Uniprot ID: Q9NYF3
  ENST ID: ENST00000239906
  CDS Start-End: 429-1607
ggagggggtgactcgttagtgaggaaaccacccccatccctaaatcaaagcgccaggctcgttcccaacagcgctgtccgagagacactttgagagagacacgacacggagctgcgccctccatgggtggcttggggggattctgcgagccggagctgtccccctactctcctcagggactcgttggttcgcgccagcgccttttaagggcaccgtggggcgaaccgagcgctcagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctgtggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctcctcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagcaa

SEQ ID NO: 132758 - DNA, 1686 bp, Homo sapiens
  Payload ID: 5941
  Gene Symbol: FAM53C
  Gene Name: family with sequence similarity 53, member C
  Uniprot ID: Q9NYF3
  ENST ID: ENST00000434981
  CDS Start-End: 495-1673
tcataatcacaatcccattacctcatcctgctgggggggagggggcggagagagaagagagggagtgaacagccctgggctatcctgagctttacaaagtgttctgggtgagggcaaattacagaaccaagtggaaacgtccccgcaaccattataagtcctgggtttttaaggttcaggccgatccggcagctgcaagaggggctcctgggactccgagcaggccctaatccgcgcttggaccacacttcccagcagccttcacgccgcggacgggtcctttgctgggggaagggggattccttcgaagaggtggtcgtggagggcggggcagcagagcagactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggcta

SEQ ID NO: 132759 - DNA, 923 bp, Homo sapiens
  Payload ID: 5941
  Gene Symbol: FAM53C
  Gene Name: family with sequence similarity 53, member C
  ENST ID: ENST00000513056
  CDS Start-End: 195-539
agagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactca

SEQ ID NO: 132760 - DNA, 571 bp, Homo sapiens
  Payload ID: 5941
  Gene Symbol: FAM53C
  Gene Name: family with sequence similarity 53, member C
  ENST ID: ENST00000511276
  CDS Start-End: 75-571
gagctgctccggccgcggccctgggagctggaggaaccgcgactcagcaggcatgactggagagggaagtcccaatggtgctagaatggtgctgcagtggcagaagacggctcacaagtgagcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcc

SEQ ID NO: 132761 - DNA, 2013 bp, Homo sapiens
  Payload ID: 5942
  Gene Symbol: FAM57A
  Gene Name: family with sequence similarity 57, member A
  Uniprot ID: Q8TBR7
  ENST ID: ENST00000301324
  CDS Start-End: 65-742
ccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttga

SEQ ID NO: 132762 - DNA, 2412 bp, Homo sapiens
  Payload ID: 5942
  Gene Symbol: FAM57A
  Gene Name: family with sequence similarity 57, member A
  Uniprot ID: Q8TBR7
  ENST ID: ENST00000308278
  CDS Start-End: 237-1010
ccgccggggacgccggggaaccctccgggcccagggaccgcgagagaccccgccccgccctatcgcagccgccgggcctggtcacgcgcagagccgcgccgcgggatcggggccagcgccgggcggaggcgggacggggacgggggcggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaactta

SEQ ID NO: 132763 - DNA, 852 bp, Homo sapiens
  Payload ID: 5942
  Gene Symbol: FAM57A
  Gene Name: family with sequence similarity 57, member A
  ENST ID: ENST00000574327
  CDS Start-End: 237-686
ccgccggggacgccggggaaccctccgggcccagggaccgcgagagaccccgccccgccctatcgcagccgccgggcctggtcacgcgcagagccgcgccgcgggatcggggccagcgccgggcggaggcgggacggggacgggggcggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaagggccgggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcagaggctccggggagaccttggggacttctttgtcggctgcatcttcacggcagaactgagcactccgtttgtgtcgctgggca

SEQ ID NO: 132764 - DNA, 2386 bp, Homo sapiens
  Payload ID: 5942
  Gene Symbol: FAM57A
  Gene Name: family with sequence similarity 57, member A
  ENST ID: ENST00000570699
  CDS Start-End: 80-421
cttcttcccggggctcttcgcgctctgcacctgggcgctgcgccgctcccagcccggatggagccgcaccgactgcgtgatgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaagggccgggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgct

SEQ ID NO: 132765 - DNA, 373 bp, Homo sapiens
  Payload ID: 5942
  Gene Symbol: FAM57A
  Gene Name: family with sequence similarity 57, member A
  ENST ID: ENST00000572018
  CDS Start-End: 103-312
cggggacgggggcggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcagctaaagcagcagcacacccttctgtacaaggtgaatggaatcctcacgctggccaccttcctttc

SEQ ID NO: 132766 - DNA, 867 bp, Homo sapiens
  Payload ID: 5942
  Gene Symbol: FAM57A
  Gene Name: family with sequence similarity 57, member A
  ENST ID: ENST00000577008
  CDS Start-End: 1-115
ggccaccggctcggggatcgtcatcattcgctcctgcgacgacgtgatcaccggcagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaa

SEQ ID NO: 132767 - DNA, 1481 bp, Homo sapiens
  Payload ID: 5943
  Gene Symbol: FAM57B
  Gene Name: family with sequence similarity 57, member B
  Uniprot ID: Q71RH2
  ENST ID: ENST00000279389
  CDS Start-End: 51-725
gccagacagctaggtgtcattcagggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcca

SEQ ID NO: 132768 - DNA, 2313 bp, Homo sapiens
  Payload ID: 5943
  Gene Symbol: FAM57B
  Gene Name: family with sequence similarity 57, member B
  Uniprot ID: Q71RH2
  ENST ID: ENST00000380495
  CDS Start-End: 733-1557
ggagacgccgctgcaggtccggtttctcggtgtctggtcggtgccatcattttcctgcccctcccccgtcctccccaagctggccacttcccctccccctccccctccccaccgagggggcagggggctgggcacggagtctctatgatgatgccatgtgcggtgtctgtgccgggcggcagggactggggcggcagcgagaggaggcagtggagccaggagagcggtggtgaccgctgaccgcttgcccggctgctcctccgctccctcccgcccacctccttcctttggggctggtactcagacccacccccaccccctccccgcctcctcgggccctcccagcctctcacgtaagcctcccctccccacctgcctggtggctccctcccctcccccatccgcatcctcctcctcctgtcccctcttcctctctgtccctcaccaagccatcccctctttgcctctccccatccctcgctggcctgctcctgctccccttctcccatcctcccctcccccgtctctgcccagccagccccctcccgactccccagtttcatcggactccctggccccatcccgtccccgccctggcccctttgtgccccttctcatcgttttctccctccttcccgggcttggcgtcccttctccacccctaactccttccactcggcctccctgccccttcacggcccgcctgcctccctgcccaagtcctgagccaccatgctgaccccgatggtggccgggggggtggtgttccccggactcttcctcctctccaagaacacgctccagcggctgccccagctacgctgggaggaggccgacgcagtcattgtctcagccaggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcca

SEQ ID NO: 132769 - DNA, 937 bp, Homo sapiens
  Payload ID: 5943
  Gene Symbol: FAM57B
  Gene Name: family with sequence similarity 57, member B
  ENST ID: ENST00000561666
  CDS Start-End: 499-937
cgcggggagcgaaggggaagagcgaatcccgccgccgcccgcctgggtcggatcctcatcagatgccggacgttggaggaggcaccgggttctggggcgccacaggaggattgaacccccaggctacacccaccacttggatgtatctccggccaagccactgagcatctgcaaaagggagaaacgcctgccgctcagggatattggcacccggtggagaggatgagtgaaacagcctgtgggcggcagaacctggaagaacagagaacgacaagcctgtgcagccttggactgttttgctctcaacaagaagaaatcgacaaggaaaggaagaaatgtaggagagagtccagattccagtgagactcgggcctgactctaaccagctcatggcctgtaaactttcctcccttccacattttcttgtctaggttctgggtgctgaggagaaacatcaacctccctttctgtcttccaacctgtccctctgaggcaggcatgaccctgctgttcgcagtgggttgcgtcttcttcccgttgtgcttcactgccctgcgctggggcttgcagaaccacaccaacctgcagatggagagacaagaggctgtcctggtagcatccaagctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactct

SEQ ID NO: 132770 - DNA, 876 bp, Homo sapiens
  Payload ID: 5943
  Gene Symbol: FAM57B
  Gene Name: family with sequence similarity 57, member B
  ENST ID: ENST00000569508
  CDS Start-End: 383-511
agtttgacaccttccttttatcccgagaaggtcccttggaagacacttcaggaaggcaggatggcaggacctggttcccttcatcctgcctgtgcctgctccacacctctgctccccagagtagatgggaggggaggtctttctaaacaaaaatgatatctatgtaaatatatgtagtttcaggcttgcacctgttatttcttttgttttcttttttaatggaacaacaatcgctttggctttattttgttttttcaacaaatgtcattttaaagttccaaatatcttgacaaccccctcccttcctttttccaagttctgggtgctgaggagaaacatcaacctccctttctgtcttccaacctgtccctctgaggcaggcatgaccctgctgttcgcagtgggttgcgtcttcttcccgttgtgcttcactgccctgcgctggggcttgcagaaccacaccaacctgcagatggagagacaagaggctgtcctggtagcatccaagtaagaggaccagggtgagggtgtccttcctggggccatggctggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgagt

SEQ ID NO: 132771 - DNA, 1710 bp, Homo sapiens
  Payload ID: 5943
  Gene Symbol: FAM57B
  Gene Name: family with sequence similarity 57, member B
  ENST ID: ENST00000564806
  CDS Start-End: 47-559
acgcctccctctctcccccaggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccaggtgagtgagcatgggagggtgcaggagcccaatggggaggtcacaggaaggggagggaccttcaaggttgctgccaagggctctagccccttcgtcatccccccctcaccccgtgcattttgagcacctggtgcttgtgtcctggcaaagtgtctggtttgggaggagctgcctgctagggtcgcagggaggcagggagagggccaaggggggccgagcccttctgctgccgtggccactgtgtctgtgtctcctcagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaa

SEQ ID NO: 132772 - DNA, 502 bp, Homo sapiens
  Payload ID: 5943
  Gene Symbol: FAM57B
  Gene Name: family with sequence similarity 57, member B
  ENST ID: ENST00000571269
  CDS Start-End: 450-502
tcatcagatgccggacgttggaggaggcaccgggttctggggcgccacaggaggattgaacccccaggctacacccaccacttggatgtatctccggccaagccactgagcatctgcaaaagggagaaacgcctgccgctcagggatattctttttctggtgtgcagatagagggtgggactggcattgcttgggacagtccctaacctgggacagggcacccggtggagaggatgagtgaaacagcctgtgggcggcagaacctggaagaacagagaacgacaagcctgtgcagccttggactgttttgctctcaacaagaagaaatcgacaaggaaaggaagaaatgtaggagagagtccagattccagtgagactcgggcctgactctaaccagctcatggcctgtaaactttcctcccttccacattttcttgtctagggcaggcatgaccctgctgttcgcagtgggttgcgtcttcttcccgttgtgcttcactgc

SEQ ID NO: 132773 - DNA, 1164 bp, Homo sapiens
  Payload ID: 5944
  Gene Symbol: FAM58A
  Gene Name: family with sequence similarity 58, member A
  Uniprot ID: Q8N1B3
  ENST ID: ENST00000440428
  CDS Start-End: 45-731
gcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatac

SEQ ID NO: 132774 - DNA, 593 bp, Homo sapiens
  Payload ID: 5944
  Gene Symbol: FAM58A
  Gene Name: family with sequence similarity 58, member A
  ENST ID: ENST00000429336
  CDS Start-End: 1-283
ggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatc

SEQ ID NO: 132775 - DNA, 1306 bp, Homo sapiens
  Payload ID: 5944
  Gene Symbol: FAM58A
  Gene Name: family with sequence similarity 58, member A
  Uniprot ID: Q8N1B3
  ENST ID: ENST00000576892
  CDS Start-End: 114-860
ggcggggccggacgcggccgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaataggga

SEQ ID NO: 132776 - DNA, 578 bp, Homo sapiens
  Payload ID: 5944
  Gene Symbol: FAM58A
  Gene Name: family with sequence similarity 58, member A
  ENST ID: ENST00000482182
  CDS Start-End: 154-578
ttgtagcaatgatctgaatgtatcagaatgactccagtgactgtcactaacttgggagtgagtacctttggggttctatgtccctaaagcctgatgcaccatttcctgcttgtggaagacgcgaatgaaaaatgagatggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcct

SEQ ID NO: 132777 - DNA, 1220 bp, Homo sapiens
  Payload ID: 5944
  Gene Symbol: FAM58A
  Gene Name: family with sequence similarity 58, member A
  ENST ID: ENST00000621629
  CDS Start-End: 45-164
gcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatac

SEQ ID NO: 132778 - DNA, 916 bp, Homo sapiens
  Payload ID: 5944
  Gene Symbol: FAM58A
  Gene Name: family with sequence similarity 58, member A
  ENST ID: ENST00000621817
  CDS Start-End: 44-163
cgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggaggctaaatattgatttcccaaagatgtccctatcctaatccctggaacctgtgaatgtcatcttatatagcaaaagagattttgaagatgtgattagagaccttaagatgggagatcatcctagattatctgggtgtaaccacacccatccttataaggcaaaggcaggaggagtcaccgtcagagaaggccacgtgaggacagaagcagagttagaagctttgaagatggaggaaggggccagcaaccaaggaatgcagccctcctctagaagctggaaaaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctc

SEQ ID NO: 132779 - DNA, 1006 bp, Homo sapiens
  Payload ID: 5944
  Gene Symbol: FAM58A
  Gene Name: family with sequence similarity 58, member A
  ENST ID: ENST00000614851
  CDS Start-End: 1-290
ggcccggaggggcagccggcgcccgaagccagggtgcacttccgagtggcgaggttcatcatggaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtc

SEQ ID NO: 132780 - DNA, 1160 bp, Homo sapiens
  Payload ID: 5944
  Gene Symbol: FAM58A
  Gene Name: family with sequence similarity 58, member A
  ENST ID: ENST00000620088
  CDS Start-End: 45-164
gcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatac

SEQ ID NO: 132781 - DNA, 509 bp, Homo sapiens
  Payload ID: 5944
  Gene Symbol: FAM58A
  Gene Name: family with sequence similarity 58, member A
  ENST ID: ENST00000614850
  CDS Start-End: 1-509
gcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagcc

SEQ ID NO: 132782 - DNA, 3163 bp, Homo sapiens
  Payload ID: 5945
  Gene Symbol: FAM60A
  Gene Name: family with sequence similarity 60, member A
  Uniprot ID: Q9NP50
  ENST ID: ENST00000337682
  CDS Start-End: 370-1035
ctctggccgccgcgtttcccgcgccgcggagcttctccccttaaaaggacaatagaggcctcgggagcgcgcgcggtcgccgggacttctccccctcccagcccgcaacgtgcgcgcgcccgtatgcaaataagttcgattcaagagaattttgtgccgggagccgcgcgtgcgcagagggaaagcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaa

SEQ ID NO: 132783 - DNA, 1555 bp, Homo sapiens
  Payload ID: 5945
  Gene Symbol: FAM60A
  Gene Name: family with sequence similarity 60, member A
  Uniprot ID: Q9NP50
  ENST ID: ENST00000454658
  CDS Start-End: 240-905
gttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttacttgctggctcggcgtctctctcggcagtcaccggagtgcccgagggggaagcacgatttacggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttg

SEQ ID NO: 132784 - DNA, 669 bp, Homo sapiens
  Payload ID: 5945
  Gene Symbol: FAM60A
  Gene Name: family with sequence similarity 60, member A
  ENST ID: ENST00000543615
  CDS Start-End: 290-669
cgccattcgctcggaaactaagttgccatccgcttccgagctggcggccgagggtctttaaatcggcctttgggggtcagtgctgggctctgccggagcgcacgcggcgtggcgttgtttgctcaactccggagggatgcggatgcgacaatgagagcaacacgcggtcgcttaaaaacagcccgtcttccactcgcctgccctcttcggaccgcgcccaagagcctctggtgtccggggtgctttcggagcccgaagttttgctcccgactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctc

SEQ ID NO: 132785 - DNA, 738 bp, Homo sapiens
  Payload ID: 5945
  Gene Symbol: FAM60A
  Gene Name: family with sequence similarity 60, member A
  Uniprot ID: Q9NP50
  ENST ID: ENST00000542983
  CDS Start-End: 493-714
gcagagggaaagcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaagggga

SEQ ID NO: 132786 - DNA, 845 bp, Homo sapiens
  Payload ID: 5945
  Gene Symbol: FAM60A
  Gene Name: family with sequence similarity 60, member A
  ENST ID: ENST00000544921
  CDS Start-End: 1-178
ccgaagtatagagggctgctgtatttgcagagctaagtcctccagttctcgattcactgacagtaaacgctatgaaaaggacttccagagctgttttggagacaatgtcttcctatgttgcctaggctggagtgcagtagctattcacaggtgtgatcattgtgcaccacagccttgaacttttgggctcaagtgatcctcccgtctgagcctctcgagtagctgggactacagattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactg

SEQ ID NO: 132787 - DNA, 2532 bp, Homo sapiens
  Payload ID: 5945
  Gene Symbol: FAM60A
  Gene Name: family with sequence similarity 60, member A
  Uniprot ID: Q9NP50
  ENST ID: ENST00000539409
  CDS Start-End: 183-404
gttgaggaggagggagcgcttgagggggactggcctggcgtgcactccgcacctcggggacattattgcgcgtggaacggctgcttttggaagattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaa

SEQ ID NO: 132788 - DNA, 459 bp, Homo sapiens
  Payload ID: 5945
  Gene Symbol: FAM60A
  Gene Name: family with sequence similarity 60, member A
  ENST ID: ENST00000539004
  CDS Start-End: 57-459
attcccaagaccaccagttactggaattatttctggactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctc

SEQ ID NO: 132789 - DNA, 3163 bp, Homo sapiens; identical to SEQ ID NO: 132782
  Payload ID: 5945
  Gene Symbol: FAM60A
  Gene Name: family with sequence similarity 60, member A
  Uniprot ID: Q9NP50
  ENST ID: ENST00000617411
  CDS Start-End: 370-1035

SEQ ID NO: 132790 - DNA, 669 bp, Homo sapiens; identical to SEQ ID NO: 132784
  Payload ID: 5945
  Gene Symbol: FAM60A
  Gene Name: family with sequence similarity 60, member A
  ENST ID: ENST00000632726
  CDS Start-End: 290-669

SEQ ID NO: 132791 - DNA, 459 bp, Homo sapiens; identical to SEQ ID NO: 132788
  Payload ID: 5945
  Gene Symbol: FAM60A
  Gene Name: family with sequence similarity 60, member A
  ENST ID: ENST00000632259
  CDS Start-End: 57-459

SEQ ID NO: 132792 - DNA, 845 bp, Homo sapiens; identical to SEQ ID NO: 132786
  Payload ID: 5945
  Gene Symbol: FAM60A
  Gene Name: family with sequence similarity 60, member A
  ENST ID: ENST00000631546
  CDS Start-End: 1-178

SEQ ID NO: 132793 - DNA, 738 bp, Homo sapiens; identical to SEQ ID NO: 132785
  Payload ID: 5945
  Gene Symbol: FAM60A
  Gene Name: family with sequence similarity 60, member A
  Uniprot ID: Q9NP50
  ENST ID: ENST00000633815
  CDS Start-End: 493-714

SEQ ID NO: 132794 - DNA, 1555 bp, Homo sapiens; identical to SEQ ID NO: 132783
  Payload ID: 5945
  Gene Symbol: FAM60A
  Gene Name: family with sequence similarity 60, member A
  Uniprot ID: Q9NP50
  ENST ID: ENST00000633702
  CDS Start-End: 240-905

SEQ ID NO: 132795 - DNA, 2532 bp, Homo sapiens; identical to SEQ ID NO: 132787
  Payload ID: 5945
  Gene Symbol: FAM60A
  Gene Name: family with sequence similarity 60, member A
  Uniprot ID: Q9NP50
  ENST ID: ENST00000631598
  CDS Start-End: 183-404

SEQ ID NO: 132796 - DNA, 2400 bp, Homo sapiens
  Payload ID: 5946
  Gene Symbol: FAM63A
  Gene Name: family with sequence similarity 63, member A
  Uniprot ID: Q8N5J2
  ENST ID: ENST00000312210
  CDS Start-End: 679-1662
agagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccatccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattagctgggcgtcatggtgggcgcctgtaatcccagctactcgggaggctgaggcaggagaatcacttgaacctgggaggtgaaagttgcagtgagccgagatcgcaccattgcactccagcctgggcgacaagagcaaaactgtctaaaaaaaaaaaaaa

SEQ ID NO: 132797 - DNA, 1961 bp, Homo sapiens
  Payload ID: 5946
  Gene Symbol: FAM63A
  Gene Name: family with sequence similarity 63, member A
  Uniprot ID: Q8N5J2
  ENST ID: ENST00000361738
  CDS Start-End: 221-1774
tttccggcgaggccaagggggcgtggcgtggggcgacgtgggaaacgtagtcccgcaactccgcaatgtccctagcaaccgagggaaggattgttttctgagggatcagtcgttcggtaaacaaatgtctttggggagctgacacctgctgtccttccacctttggtctgcaagtctggattgcttagaggagctaagtcaggagagacatgtaaaggggatgctgcttggtcctcctccttttaatgaaagcacgaaaccttccccctctccttgtcactcttttgcatcccaagcctggcttaggcaagtccctgaggttagtaaacaccttcagtgcccctcagccaagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctct

SEQ ID NO: 132798 - DNA, 2817 bp, Homo sapiens
  Payload ID: 5946
  Gene Symbol: FAM63A
  Gene Name: family with sequence similarity 63, member A
  Uniprot ID: Q8N5J2
  ENST ID: ENST00000361936
  CDS Start-End: 956-2365
ggccaagggggcgtggcgtggggcgacgtgggaaacgtagtcccgcaactccgcaatgtccctagcaaccgagggaaggattgttttctgagggatcagtcgttcggtaaacaaatgtctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccaagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccatccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggca

SEQ ID NO: 132799 - DNA, 1546 bp, Homo sapiens
  Payload ID: 5946
  Gene Symbol: FAM63A
  Gene Name: family with sequence similarity 63, member A
  Uniprot ID: Q8N5J2
  ENST ID: ENST00000493834
  CDS Start-End: 243-1367
acaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctg

SEQ ID NO: 132800 - DNA, 508 bp, Homo sapiens
  Payload ID: 5946
  Gene Symbol: FAM63A
  Gene Name: family with sequence similarity 63, member A
  ENST ID: ENST00000497067
  CDS Start-End: 1-428
ctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggtgggctgctgcctgggcgcccacactcccggtttccacctcatgctttgccgggtccagaacacctgttattcctgcactggtctcttcaaggtttcttctctcagagtccttcccctgcctgtccctctcccctggagccccttcctgtcttcctctccctactctctgtcccaatcctgacaccccttcttctagaatctcttcttgtgctcttccaaggaagttcagtgaccaattgttaaatccgatacaggggagag

SEQ ID NO: 132801 - DNA, 2637 bp, Homo sapiens
  Payload ID: 5946
  Gene Symbol: FAM63A
  Gene Name: family with sequence similarity 63, member A
  Uniprot ID: Q8N5J2
  ENST ID: ENST00000622754
  CDS Start-End: 445-1854
ctggcagcccccttcattgcacctatctcccccatctcattgccacggctgaaccctccttctcaatcttggaacagcacccccttctttaagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccaagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccatccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattagctgggactacaggcatgcgccactgcgcccagctaatttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaacc

SEQ ID NO: 132802 - DNA, 4866 bp, Homo sapiens
  Payload ID: 5947
  Gene Symbol: FAM63B
  Gene Name: family with sequence similarity 63, member B
  ENST ID: ENST00000316848
  CDS Start-End: 205-1473
gcagtcaggcggaggcaagctcagagcgcacggacagagcggtagcgcgcgcccgcgcgcgttcttagtactctccccggtgacgtgcctgaccgaggccgcgccagggcgctgttgctgccaatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgacattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagttttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaa

SEQ ID NO: 132803 - DNA, 4820 bp, Homo sapiens
  Payload ID: 5947
  Gene Symbol: FAM63B
  Gene Name: family with sequence similarity 63, member B
  Uniprot ID: Q8NBR6
  ENST ID: ENST00000450403
  CDS Start-End: 35-1897
cggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgacattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagttttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctc

SEQ ID NO: 132804 - DNA, 9238 bp, Homo sapiens
  Payload ID: 5947
  Gene Symbol: FAM63B
  Gene Name: family with sequence similarity 63, member B
  Uniprot ID: Q8NBR6
  ENST ID: ENST00000559228
  CDS Start-End: 83-1948
aatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgacattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagttttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgcacaaaaccttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcgtgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaaggacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaaaaaaaaaaaaaaaaagtcaagaaactgaaattcccatttaagttctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacagcttgttacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcgtgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaactttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagaccaaa

SEQ ID NO: 132805 - DNA, 1859 bp, Homo sapiens
  Payload ID: 5947
  Gene Symbol: FAM63B
  Gene Name: family with sequence similarity 63, member B
  ENST ID: ENST00000560289
  CDS Start-End: 111-1250
gaggccgcgccagggcgctgttgctgccaatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatattgatgacattgtaaaagctgttggtaactgcagctacaaccaactagtggagaagatcatctcttgtaaacagtcagacaatagtgagctggttagtgaaggtgggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagcagggccagccagcacaagcctctccatcaagtggaagacaatctgggaatagtgaacgtaaacggaaggaaccacgagaaaaagataaagaaaaagaaaaggaaaaaaa

SEQ ID NO: 132806 - DNA, 1473 bp, Homo sapiens
  Payload ID: 5948
  Gene Symbol: FAM64A
  Gene Name: family with sequence similarity 64, member A
  Uniprot ID: Q9BSJ6
  ENST ID: ENST00000250056
  CDS Start-End: 84-830
ggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatttga

SEQ ID NO: 132807 - DNA, 833 bp, Homo sapiens
  Payload ID: 5948
  Gene Symbol: FAM64A
  Gene Name: family with sequence similarity 64, member A
  Uniprot ID: Q9BSJ6
  ENST ID: ENST00000576056
  CDS Start-End: 50-766
cttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcagcacgctgggggccccaagtagctacagccaccttccagcaccccccaccccgc

SEQ ID NO: 132808 - DNA, 1551 bp, Homo sapiens
  Payload ID: 5948
  Gene Symbol: FAM64A
  Gene Name: family with sequence similarity 64, member A
  ENST ID: ENST00000572595
  CDS Start-End: 79-918
ggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccaggggataaacttcaggagctgccgagaaggtccagttagaggggatttgctgtcaaatgagagctgctgtcaggaagacgtccttatattggatagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactat

SEQ ID NO: 132809 - DNA, 1948 bp, Homo sapiens
  Payload ID: 5948
  Gene Symbol: FAM64A
  Gene Name: family with sequence similarity 64, member A
  Uniprot ID: Q9BSJ6
  ENST ID: ENST00000572447
  CDS Start-End: 110-826
cgcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatttgacatctgttccctttcaccggcaacctccaacctcccccgccctcccacaccactctgggctatagatttgtaatttgtggtttggggtctggccctcatccacctctgctccgagccagtctgcccccaatcccaccccagggagaacatgtagaaagggaaaggtttctcaacttagttcagaccaaaacacattgtaaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaa

SEQ ID NO: 132810 - DNA, 1002 bp, Homo sapiens
  Payload ID: 5948
  Gene Symbol: FAM64A
  Gene Name: family with sequence similarity 64, member A
  ENST ID: ENST00000571373
  CDS Start-End: 82-825
cgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagaactctccgtggctcgtctgtgccctgcctgcctatggaattgggaaaagcaacctgactgctatggagttcctggtctgtctgctcatggccccatcctgggggcagggcctcggttgtggacctcccctaacttggggctgtttccccattccacttgtataatggccatgatgggctctaaggctgggccctgccagctctatgtgttgaggggccatattcctaccacatt

SEQ ID NO: 132811 - DNA, 928 bp, Homo sapiens
  Payload ID: 5948
  Gene Symbol: FAM64A
  Gene Name: family with sequence similarity 64, member A
  ENST ID: ENST00000571572
  CDS Start-End: 1-391
gtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttcctt

SEQ ID NO: 132812 - DNA, 891 bp, Homo sapiens
  Payload ID: 5948
  Gene Symbol: FAM64A
  Gene Name: family with sequence similarity 64, member A
  ENST ID: ENST00000570337
  CDS Start-End: 82-825
cgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagaactctccgtggctcgtctgtgccctgcctgcctatggaattgggaaaagcaacctgactgctatggagttcctgtggtgacatcgtctctctcattcatgactgaggaagtgcctgcaggaaa

SEQ ID NO: 132813 - DNA, 831 bp, Homo sapiens
  Payload ID: 5948
  Gene Symbol: FAM64A
  Gene Name: family with sequence similarity 64, member A
  ENST ID: ENST00000573557
  CDS Start-End: 83-619
gcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccc

SEQ ID NO: 132814 - DNA, 4051 bp, Homo sapiens
  Payload ID: 5949
  Gene Symbol: FAM65A
  Gene Name: family with sequence similarity 65, member A
  Uniprot ID: Q6ZS17
  ENST ID: ENST00000042381
  CDS Start-End: 69-3728
cgagcgcaaggacagcgcgaggtccgcgcagcccagcgcagccatggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttccta

SEQ ID NO: 132815 - DNA, 4116 bp, Homo sapiens
  Payload ID: 5949
  Gene Symbol: FAM65A
  Gene Name: family with sequence similarity 65, member A
  Uniprot ID: Q6ZS17
  ENST ID: ENST00000379312
  CDS Start-End: 122-3793
ggcgcctgcggcggcgacagcggcagctgcggcgcgaccaggccgggcacctccgagcgcaaggacagcgcgaggtccgcgcagcccagcgcagccatggagccccgcgcggactcactctatgatgtccctgtcggtgcggccgcagcgccgtctgctcagcgcccgggtcaataggagccagtccttcgcaggcgtcctcggcagccacgagcgggggcccagcctctccttcaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttccta

SEQ ID NO: 132816 - DNA, 4152 bp, Homo sapiens
  Payload ID: 5949
  Gene Symbol: FAM65A
  Gene Name: family with sequence similarity 65, member A
  Uniprot ID: Q6ZS17
  ENST ID: ENST00000428437
  CDS Start-End: 126-3827
gaggagccgaagccgagccagagccgctgggagcgagcccggagcccagccgggcggctcgaagtggccagggccggaaggtccgcggggggcgagcgcgggtcgggggccgtcccggacccaccatgaacaccaagaagagagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctaca

SEQ ID NO: 132817 - DNA, 4228 bp, Homo sapiens
  Payload ID: 5949
  Gene Symbol: FAM65A
  Gene Name: family with sequence similarity 65, member A
  Uniprot ID: Q6ZS17
  ENST ID: ENST00000422602
  CDS Start-End: 187-3906
ggtgagccctgagtccggcctcccctacagaccctccccagccagttctaacgtgtgtccaggctggccgccccagcacctactgtgcgcagcctcgtgtaacaatacttgtgccctggctgcagtctgcggggccgcgccctgggcctgccgcattcggccaacgcacagcatctgaggagggttatgaccatctggcagatgcagaaacaggcccagagagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcct

SEQ ID NO: 132818 - DNA, 4260 bp, Homo sapiens
  Payload ID: 5949
  Gene Symbol: FAM65A
  Gene Name: family with sequence similarity 65, member A
  ENST ID: ENST00000540839
  CDS Start-End: 221-3937
acagcgcgaggtccgcgcagcccagcgcagccatggtgagccctgagtccggcctcccctacagaccctccccagccagttctaacgtgtgtccaggctggccgccccagcacctactgtgcgcagcctcgtgtaacaatacttgtgccctggctgcagtctgcggggccgcgccctgggcctgccgcattcggccaacgcacagcatctgaggagggttatgaccatctggcagatgcagaaacaggcccagagagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttccta

SEQ ID NO: 132819 - DNA, 1874 bp, Homo sapiens
  Payload ID: 5949
  Gene Symbol: FAM65A
  Gene Name: family with sequence similarity 65, member A
  ENST ID: ENST00000569253
  CDS Start-End: 107-1874
agagccgctgggagcgagcccggagcccagccgggcggctcgaagtggccagggccggaaggtccgcggggggcgagcgcgggtcgggggccgtcccggacccaccatgaacaccaagaagagagggagccccgcgcggactcactctatgatgtccctgtcggtgcggccgcagcgccgtctgctcagcgcccgggtcaataggagccagtccttcgcaggcgtcctcggcagccacgagcgggggcccagggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccataccccca

SEQ ID NO: 132820 - DNA, 418 bp, Homo sapiens
  Payload ID: 5949
  Gene Symbol: FAM65A
  Gene Name: family with sequence similarity 65, member A
  ENST ID: ENST00000569179
  CDS Start-End: 1-418
ccgaatgaaagggctggctggcttcgccaggctgtgtgtaggcgatcagtatgaggctgcctcatcctacctgttcccccagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtc

SEQ ID NO: 132821 - DNA, 244 bp, Homo sapiens
  Payload ID: 5949
  Gene Symbol: FAM65A
  Gene Name: family with sequence similarity 65, member A
  ENST ID: ENST00000562116
  CDS Start-End: 220-244
ctgacattggctctcttggcttcctgggacagccctcaccagcatcctgggctctcaagagcctgggctggtggctgccatccccccaggacaggagcccaccaagtcccttctggttgaggacccttgggccctcaaggatcccaactctgctcatgatggcatctgggggagcgcgggagccctggaggggaagggagccccgcgcggactcactctatgatgtccctgtcggtgcggccgc

SEQ ID NO: 132822 - DNA, 562 bp, Homo sapiens
  Payload ID: 5949
  Gene Symbol: FAM65A
  Gene Name: family with sequence similarity 65, member A
  ENST ID: ENST00000565176
  CDS Start-End: 107-562
aggagagggacttggggctgagtagtgggaagaaggaataggagcgatgggggctgccggtcagattctgaagaaccttgcagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctc

SEQ ID NO: 132823 - DNA, 584 bp, Homo sapiens
  Payload ID: 5949
  Gene Symbol: FAM65A
  Gene Name: family with sequence similarity 65, member A
  ENST ID: ENST00000566920
  CDS Start-End: 321-584
attcggccaacgcacagcatctgaggagggttatgaccatctggcagatgcagaaacaggcccagagaggttagtagtattctcaaggtcacacagctggtttgggagaagcgaggattagatctgagtccttgcccctgcgacacccacctccgtggtattggagggaggagaggaatgataattgggggctgaggtacaaaatactccagcgggacaaggaggactggcatagctccttcttccaccgccctctccggcttgggtcctgtgactgcggcgggagagaggagcaagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctac

SEQ ID NO: 132824 - DNA, 2251 bp, Homo sapiens
  Payload ID: 5949
  Gene Symbol: FAM65A
  Gene Name: family with sequence similarity 65, member A
  ENST ID: ENST00000566559
  CDS Start-End: 370-2251
aaacaggcgcttccgcacattcttcgcgcgcgccgcccctttcctgccccttcccagccggaggagggtccccgcgcgaccccccttcctgccccgcggcaggcggagcccgcacctcggcaggaagtgggggccgagccgaggccacgctgagtccgaggccgagtcgcctgcggctgtcctgtcattagtgcccgggtcggcgggactaggcggacccggccggagcccgctggggcagctgtgcctagcgacaggaaagacctgcgccagccctggatcccgctgcgtgggagagggcttcggggatccgactggtactggacacccccccgatcacccgcagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaa

SEQ ID NO: 132825 - DNA, 467 bp, Homo sapiens
  Payload ID: 5949
  Gene Symbol: FAM65A
  Gene Name: family with sequence similarity 65, member A
  ENST ID: ENST00000568959
  CDS Start-End: 1-467
tggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaag

SEQ ID NO: 132826 - DNA, 929 bp, Homo sapiens
  Payload ID: 5949
  Gene Symbol: FAM65A
  Gene Name: family with sequence similarity 65, member A
  ENST ID: ENST00000566815
  CDS Start-End: 1-607
gcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggag

SEQ ID NO: 132827 - DNA, 538 bp, Homo sapiens
  Payload ID: 5949
  Gene Symbol: FAM65A
  Gene Name: family with sequence similarity 65, member A
  ENST ID: ENST00000562755
  CDS Start-End: 250-538
gcatgacccggctatgagcctggacttaccagccagacagtggcagaaagggcggcctgcctctacagcgacgctgaggctggctgaaatggcagggctgaagggcagcgtctggacccagaaggtgccaggcggcttctggactccccaaggccttcacaacagccctggatcctttccaccaaccagcctaagccagcagtagcagctccaggacctgtttcagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaag

SEQ ID NO: 132828 - DNA, 634 bp, Homo sapiens
  Payload ID: 5949
  Gene Symbol: FAM65A
  Gene Name: family with sequence similarity 65, member A
  ENST ID: ENST00000566907
  CDS Start-End: 477-634
gagctaatcctcctagctctaggggccggcctaagcggctttgtggccggccccgaggtgaccgagcctgggctggagccgggctctccgcccaaacctggcgtagccgaagccggagaggatcgtccttgtcggggaacggagcttttccctggaaatggaggttggcgcaaggttcctgcaacagccgggcctgggctctctgcagaactggtttgggcaaggggctgctcaccagggctagaggtcggattcagtccagattcagcaccctttgtcctcctctccagggtgagccctgagtccggcctcccctacagaccctccccagccagttctaacgtgtgtccaggctggccgccccagcacctactgtgcgcagcctcgtgtaacaatacttgtgccctggctgcagtctgcggggccgcgccctgggcctgccgcattcggccaacgcacagcatctgaggagggttatgaccatctggcagatgcagaaacaggcccagagagggagccccgcgcggactcactctatgatgtccctgtcggtgcggccgcagcgccgtctgctcagcgcccgggtcaataggagccagtccttcgcaggcgtcctcggcagccacgagcgggg

SEQ ID NO: 132829 - DNA, 5471 bp, Homo sapiens
  Payload ID: 5950
  Gene Symbol: FAM65B
  Gene Name: family with sequence similarity 65, member B
  Uniprot ID: Q9Y4F9
  ENST ID: ENST00000259698
  CDS Start-End: 177-3383
ccggggtccccttcacccaagtgagccagctcaggctgtctgcaaagccggaggtgcgggcagctccgggcattgcattggtgcggaggcttttatatgccagagaaccctgagtgtgcccctgacatgacaaggagccgtcgtcgttaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttctttaggtggctgcatccttccccagacaagcccaggcggctgtctgtcttgagtgccttgcaagacactttctttgccaagctgcaccgcagccgctccttcagtgacctgccctccctcaggccgagtcccaaggccgtgctagagctctattcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaagctttctaggcagatccaagtgatggagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccgggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagtgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacaggttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcaggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatatattacatcgtcgattgtgtctaataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatatcttcaaataaaagtttgcctgcagaacctggcaaaatgacccattaggagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaaacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgcttttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcatttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagc

SEQ ID NO: 132830 - DNA, 2442 bp, Homo sapiens
  Payload ID: 5950
  Gene Symbol: FAM65B
  Gene Name: family with sequence similarity 65, member B
  Uniprot ID: Q9Y4F9
  ENST ID: ENST00000378023
  CDS Start-End: 432-2207
cgcaagaatgcatacaaactccagggctgctctctcctggagagggagggaggggatttaaaaacctgcagcaacatgggggaggaggctgtttgtccttctctctctggggaagtaactcgctcaaactgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaaaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgctaacaaaaaataaaaacttgaaacaaaaaaaaaa

SEQ ID NO: 132831 - DNA, 3614 bp, Homo sapiens
  Payload ID: 5950
  Gene Symbol: FAM65B
  Gene Name: family with sequence similarity 65, member B
  ENST ID: ENST00000540914
  CDS Start-End: 442-2283
acctgtacctcgcaagaatgcatacaaactccagggctgctctctcctggagagggagggaggggatttaaaaacctgcagcaacatgggggaggaggctgtttgtccttctctctctggggaagtaactcgctcaaactgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaagatgctaaacaccttgacgatcagaaactaaatggtgctgcctcttggacggagatcactgagggtgaatgagacaactgtgatttaaaagaccgaaagacgttttcccatgtgcttttgtgccatcttgagtgtcagagacagatccctgcaaggcccttcctaccttgcgctaagaaatcagcaaggagtgtcacctaactggatggaggacatttagtgcttctaacttgcagaatttgtcccattcgacccaccccagcatcctcttgaatatttggaaatacttctctccaactctgtgcccatagcaactggcattgttttgcttgtaatgtttctgcatgtggccagcattatagaatgctccaggccagagaatgggattgctcccatgatgccagggcctggtcagggaagtggtgggacttgttccctttgaggcagagctccagaggaagcagggctgcttcttgtcatgcccaaggcattcattctttcctcagtcctcagaggaaaaattatatgctgtgagcaggtgcggtggctcatgcctgtaatcccaacactttgggaagcccaggattgctggagcccaagagttcaagaccggtatggtcaacatagggagaccctgtctctgcaataaaagaaaaaaattagcctggtgtggtggcacatgcctgtggtctcagctacctgggaggctaaggtgagaggattgcttaagcccgggagattgaggctgcagtgagctgtgatcacaccactgcactccagcctgagtgacagagcaagaccttgtctcaaaaaaaaaaaaaaaaaaaaaaaaaaaaaaaagatgcagggcttcttacctagggaacatgggctaggtgaatttgaaccacttcctgtttctgggatttgttttgttagtcctttagagcagatgccttagatagctagcgccttttgtaaaacaccgaagacattgccacttggaattagagattggtcagtattcagcattgactcactgacttaaaatttgtctgcttgtggtattttattttggggtgagcactaggcagagggatatagcagttctgtttcccaaggctttgtggttgacatggttttgttttttgttttttttgttttttttcaactttttgttataaaaatttcaaacagaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgctaacaaaaaataaaaacttg

SEQ ID NO: 132832 - DNA, 5389 bp, Homo sapiens
  Payload ID: 5950
  Gene Symbol: FAM65B
  Gene Name: family with sequence similarity 65, member B
  ENST ID: ENST00000538035
  CDS Start-End: 155-3298
atatgaatgaaactgctttcttcagggcagatgcggaagctgccctccagagggcttgggcaacccaaggaaaggaaatcacctcggtcggcagtgtgactgctgagactgccggggctgctgcctgctgcttctcgcgcctgtcctctccaagatgcagttttttgatgctgaggagctcctggtcgatgaagaggatgatgtttttggtgaaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaagctttctaggcagatccaagtgatggagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccgggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagtgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacaggttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcaggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatatattacatcgtcgattgtgtctaataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatatcttcaaataaaagtttgcctgcagaacctggcaaaatgacccattaggagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaaacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgcttttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcatttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagcatc

SEQ ID NO: 132833 - DNA, 3517 bp, Homo sapiens
  Payload ID: 5950
  Gene Symbol: FAM65B
  Gene Name: family with sequence similarity 65, member B
  ENST ID: ENST00000510784
  CDS Start-End: 243-2186
agcacagcagctgccttcgggccagtcggaagttaagggaaggaaaggcaaggcaagttacaagataaaagaagtcaacggaagcctcaaatactcttttttttttttttaagaaaagaacaaaaaggggggggttaagttttctttttcatttttatacgtctggacttaacttccaggatagctgcaagacccttttgttcctttgccatgagcaggttttaggccgctctgttgggaccatggtgttaccttcgcgattacactggatcagaaacaggccatggagggacaggatccggaggcgccagctcaaccgactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaagatgctaaacaccttgacgatcagaaactaaatggtgctgcctcttggacggagatcactgagggtgaatgagacaactgtgatttaaaagaccgaaagacgttttcccatgtgcttttgtgccatcttgagtgtcagagacagatccctgcaaggcccttcctaccttgcgctaagaaatcagcaaggagtgtcacctaactggatggaggacatttagtgcttctaacttgcagaatttgtcccattcgacccaccccagcatcctcttgaatatttggaaatacttctctccaactctgtgcccatagcaactggcattgttttgcttgtaatgtttctgcatgtggccagcattatagaatgctccaggccagagaatgggattgctcccatgatgccagggcctggtcagggaagtggtgggacttgttccctttgaggcagagctccagaggaagcagggctgcttcttgtcatgcccaaggcattcattctttcctcagtcctcagaggaaaaattatatgctgtgagcaggtgcggtggctcatgcctgtaatcccaacactttgggaagcccaggattgctggagcccaagagttcaagaccggtatggtcaacatagggagaccctgtctctgcaataaaagaaaaaaattagcctggtgtggtggcacatgcctgtggtctcagctacctgggaggctaaggtgagaggattgcttaagcccgggagattgaggctgcagtgagctgtgatcacaccactgcactccagcctgagtgacagagcaagaccttgtctcaaaaaaaaaaaaaaaaaaaaaaaaaaaaaaaagatgcagggcttcttacctagggaacatgggctaggtgaatttgaaccacttcctgtttctgggatttgttttgttagtcctttagagcagatgccttagatagctagcgccttttgtaaaacaccgaagacattgccacttggaattagagattggtcagtattcagcattgactcactgacttaaaatttgtctgcttgtggtattttattttggggtgagcactaggcagagggatatagcagttctgtttcccaaggctttgtggttgacatggttttgttttttgttttttttgttttttttcaactttttgttataaaaatttcaaacagaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgctaacaaaaaataaaaacttg

SEQ ID NO: 132834 - DNA, 2277 bp, Homo sapiens
  Payload ID: 5950
  Gene Symbol: FAM65B
  Gene Name: family with sequence similarity 65, member B
  ENST ID: ENST00000612873
  CDS Start-End: 465-2075
tgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgccaacggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaaaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgct

SEQ ID NO: 132835 - DNA, 5539 bp, Homo sapiens
  Payload ID: 5950
  Gene Symbol: FAM65B
  Gene Name: family with sequence similarity 65, member B
  Uniprot ID: Q9Y4F9
  ENST ID: ENST00000613507
  CDS Start-End: 242-3448
atatgaatgaaactgctttcttcagggcagatgcggaagctgccctccagagggcttgggcaacccaaggaaaggaaatcacctcggtcggcagtgtgactgctgagactgccggggctgctgcctgctgcttctcgcgcctgtcctctccaagatgcagttttttgatgctgaggagctcctggtcgatgaagaggatgatgtttttggtgaaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttctttaggtggctgcatccttccccagacaagcccaggcggctgtctgtcttgagtgccttgcaagacactttctttgccaagctgcaccgcagccgctccttcagtgacctgccctccctcaggccgagtcccaaggccgtgctagagctctattcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaagctttctaggcagatccaagtgatggagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccgggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagtgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacaggttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcaggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatatattacatcgtcgattgtgtctaataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatatcttcaaataaaagtttgcctgcagaacctggcaaaatgacccattaggagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaaacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgcttttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcatttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagcatc

SEQ ID NO: 132836 - DNA, 4279 bp, Homo sapiens
  Payload ID: 5951
  Gene Symbol: FAM65C
  Gene Name: family with sequence similarity 65, member C
  Uniprot ID: Q96MK2
  ENST ID: ENST00000045083
  CDS Start-End: 319-3159
aacgttaaatttagatgttttacctctaaatgaggtgaaattgcaggttccctctggctggcggtggggaggagacgcagggcagctttggccagcagtgagcggacagacttagcgggagtagactctgcttcctccagccacaccttggggacggaggcccaggacagtccccagtgtctgggagcatctggcttcctctccctgcacacaccagccgggtctgaacggcatcagttctaagtgccaggccagagagaggcagcgagggacacggagtagaagaggctgtcctgtctgccaccaaaggtgaccaccatgtcggtgaggttgcggttcctgtcccctggggacacaggggccgtgggggtcgtgggccggagcgcctccttcgcaggcttcagcagtgcacagagccggaggatcgcaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccccacgggcaagttttctatgggcagcaggaagggctccttgtacaactggacacccccgagcacccccagcttccgggagagatactacctgtctgtcctacagcagccaacacagcaggccttgctgctgggtggcccaagggccacctccatcctcagctacctgtctgacagcgacctccggggtcccagcctaagaagccagagtcaggagctgcctgagatggactccttcagctctgaggacccccgagacacggagaccagcacgtcggcgtccacctcagatgtgggcttcctgcccttgaccttcggtccccacgcctccattgaagaggaggctcgggaggaccccctgcccccaggtctcctgccagagatggcccacctctctggaggcccgtttgcagagcagcctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaagccctgcagagcacggcaggagcacacctcggccgagagcctgatggagtgcatcctggagagcttcgccttcctcaatgccgacttcgccctggatgagctgtccctgtttgggggctcccagggtctccgaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagatcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggacaggccaaggtggtccggaagctgcaggggaagcggctgggccagctccagcctctgccccagaccttaagagcctgggcgctgctccagctggacggcactccgagggtgtgcagggcggccagcgctcgcctggctggtgcagtcaggaacagaagcttccgggaaaaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttaccc

SEQ ID NO: 132837 - DNA, 4377 bp, Homo sapiens
  Payload ID: 5951
  Gene Symbol: FAM65C
  Gene Name: family with sequence similarity 65, member C
  Uniprot ID: Q96MK2
  ENST ID: ENST00000327979
  CDS Start-End: 413-3253
cactgacaagcaatcggccgcgtccagagcagcaggcggcatccggggggagcggggccggctggggggccccaggagggcttcctggaaccccagctccatggccgcctgcaccctgacacaggccagataagagtcccggctgcattatcagagcccggcagggcaccggcctccctgcaccagaaggaagactcggggcgcagcaggtcctcaaggcgatcttcccagagagcgggaccagcggctggtggccagtgtggatggaatttgcagagccctagctcgagtccgggagtcccgggccagatgggagcagacgcttgctggcggcaatagggaaagtgaggcagctgcaaggagggcggcgggactgcactcgagtgtccagacctgctcgatggtgaccaccatgtcggtgaggttgcggttcctgtcccctggggacacaggggccgtgggggtcgtgggccggagcgcctccttcgcaggcttcagcagtgcacagagccggaggatcgcaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccccacgggcaagttttctatgggcagcaggaagggctccttgtacaactggacacccccgagcacccccagcttccgggagagatactacctgtctgtcctacagcagccaacacagcaggccttgctgctgggtggcccaagggccacctccatcctcagctacctgtctgacagcgacctccggggtcccagcctaagaagccagagtcaggagctgcctgagatggactccttcagctctgaggacccccgagacacggagaccagcacgtcggcgtccacctcagatgtgggcttcctgcccttgaccttcggtccccacgcctccattgaagaggaggctcgggaggaccccctgcccccaggtctcctgccagagatggcccacctctctggaggcccgtttgcagagcagcctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaagccctgcagagcacggcaggagcacacctcggccgagagcctgatggagtgcatcctggagagcttcgccttcctcaatgccgacttcgccctggatgagctgtccctgtttgggggctcccagggtctccgaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagatcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggacaggccaaggtggtccggaagctgcaggggaagcggctgggccagctccagcctctgccccagaccttaagagcctgggcgctgctccagctggacggcactccgagggtgtgcagggcggccagcgctcgcctggctggtgcagtcaggaacagaagcttccgggaaaaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttacccaaaa

SEQ ID NO: 132838 - DNA, 2574 bp, Homo sapiens
  Payload ID: 5952
  Gene Symbol: FAM69A
  Gene Name: family with sequence similarity 69, member A
  Uniprot ID: Q5T7M9
  ENST ID: ENST00000370310
  CDS Start-End: 72-1358
ggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaata

SEQ ID NO: 132839 - DNA, 2646 bp, Homo sapiens
  Payload ID: 5952
  Gene Symbol: FAM69A
  Gene Name: family with sequence similarity 69, member A
  ENST ID: ENST00000613047
  CDS Start-End: 212-1423
aatgcaaagaggatcctattgtgcagctttacactttgcaagttgatatgcaaagagtaacttatttttaatatatcttaacccttctccagtcatttctcctttaacaattgttagcgtctcctcagtttccagaatatctattcggtgaaacatttggttcgctgaacaagaggaacataaagccctggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaatatttccca

SEQ ID NO: 132840 - DNA, 2426 bp, Homo sapiens
  Payload ID: 5952
  Gene Symbol: FAM69A
  Gene Name: family with sequence similarity 69, member A
  ENST ID: ENST00000616709
  CDS Start-End: 94-1203
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaatatttccca

SEQ ID NO: 132841 - DNA, 865 bp, Homo sapiens
  Payload ID: 5952
  Gene Symbol: FAM69A
  Gene Name: family with sequence similarity 69, member A
  Uniprot ID: Q5T7M9
  ENST ID: ENST00000615519
  CDS Start-End: 94-582
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggaccagcaccggtaattgtgccaaacttttgcgaagcactgctccagacagcaatcagtgatgccaaacgtcggtttgttcggaacacgctatgtcccacttcgaaaacctagcctcaaataacaactacgtacctctctcgcttcccatgttatgtttttcaaaagcctaaattacctgccacaaagcttaactgggcaagagcacattcagcagtaattcccccactaaaacagcactgttccccatcagctaaagcaacatttcatcccacccttggggccctaccccaataatt

SEQ ID NO: 132842 - DNA, 2468 bp, Homo sapiens
  Payload ID: 5952
  Gene Symbol: FAM69A
  Gene Name: family with sequence similarity 69, member A
  ENST ID: ENST00000613902
  CDS Start-End: 94-1245
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccagtgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaatatttccca

SEQ ID NO: 132843 - DNA, 2410 bp, Homo sapiens
  Payload ID: 5953
  Gene Symbol: FAM69B
  Gene Name: family with sequence similarity 69, member B
  Uniprot ID: Q5VUD6
  ENST ID: ENST00000371691
  CDS Start-End: 1100-2134
ggccgcagcctgtcctcctgcctcagcctggggaaggctgggccgggccaaagagggaggccaagtccttgggacaggaggagacccacacctgagattagtggaaacccagccagaagctgccatgcaggtgtggctctgggcatcaggatctgtcgtgagagcccccatgagtgcccagtgcagaatggctggcagcccgccctgacggggagcagaggggctggacgcggtgcccttcacgggatgacacccagctgtttgccctgtgtccagggggttgcttctctgacagaggccctatggctcgtgtctgactcctgtccaggttctgccagcctgaccatccatcgctctggcaccaagagcccacccttttgttcttcctggcgtcccagggaaagccctgcctgggtggggcagctcctggcccttcagatggaagacgcagtccagtcagcaccatcataggaaacaagttcagaaatgtctcacttactattccgggcagggagggcgccatgagtcagggggtgcatcctccctcctggcgtcacccgaggcaggaatgaagagtcaggcagagagcgcgcgtgtggcagctggtggtgtagatattagggactagtgtgaattctagttcaccggccaatgcctggatggtccagagctgggtcggctgggcggagagctgcctccaggttcctgcctctggccctggcgtggggtcgacactgggtgtggtgtgtgtctcatgtccaggcagtggcctttgctgtgccgtcctgttacaggagccaggatggtggggacgggaccggaccggagggttggcggggctgcccctgcagccgacagccccatcctgcagccaccaatggcatgacccagggccccggcactgcctgtgtgaggggctggcagctttccaactgcagcaagtggaggcccctgccagcttcgggcctgtgggcaggggctcagtggggcaggggtgtggctgccccgcccggcacgcctgcacctgtctcctcagtgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctga

SEQ ID NO: 132844 - DNA, 1668 bp, Homo sapiens
  Payload ID: 5953
  Gene Symbol: FAM69B
  Gene Name: family with sequence similarity 69, member B
  Uniprot ID: Q5VUD6
  ENST ID: ENST00000371692
  CDS Start-End: 97-1392
gcatggcgagggagcggcggccgctgcgggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctga

SEQ ID NO: 132845 - DNA, 2394 bp, Homo sapiens
  Payload ID: 5953
  Gene Symbol: FAM69B
  Gene Name: family with sequence similarity 69, member B
  ENST ID: ENST00000617017
  CDS Start-End: 1100-1900
ggccgcagcctgtcctcctgcctcagcctggggaaggctgggccgggccaaagagggaggccaagtccttgggacaggaggagacccacacctgagattagtggaaacccagccagaagctgccatgcaggtgtggctctgggcatcaggatctgtcgtgagagcccccatgagtgcccagtgcagaatggctggcagcccgccctgacggggagcagaggggctggacgcggtgcccttcacgggatgacacccagctgtttgccctgtgtccagggggttgcttctctgacagaggccctatggctcgtgtctgactcctgtccaggttctgccagcctgaccatccatcgctctggcaccaagagcccacccttttgttcttcctggcgtcccagggaaagccctgcctgggtggggcagctcctggcccttcagatggaagacgcagtccagtcagcaccatcataggaaacaagttcagaaatgtctcacttactattccgggcagggagggcgccatgagtcagggggtgcatcctccctcctggcgtcacccgaggcaggaatgaagagtcaggcagagagcgcgcgtgtggcagctggtggtgtagatattagggactagtgtgaattctagttcaccggccaatgcctggatggtccagagctgggtcggctgggcggagagctgcctccaggttcctgcctctggccctggcgtggggtcgacactgggtgtggtgtgtgtctcatgtccaggcagtggcctttgctgtgccgtcctgttacaggagccaggatggtggggacgggaccggaccggagggttggcggggctgcccctgcagccgacagccccatcctgcagccaccaatggcatgacccagggccccggcactgcctgtgtgaggggctggcagctttccaactgcagcaagtggaggcccctgccagcttcgggcctgtgggcaggggctcagtggggcaggggtgtggctgccccgcccggcacgcctgcacctgtctcctcagtgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcaccacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgt

SEQ ID NO: 132846 - DNA, 3671 bp, Homo sapiens
  Payload ID: 5954
  Gene Symbol: FAM69C
  Gene Name: family with sequence similarity 69, member C
  Uniprot ID: Q0P6D2
  ENST ID: ENST00000343998
  CDS Start-End: 10-1269
gggctggccatggcgcgggcggcgggcgcgcggggccctgccgggtggtgcaggaggcgcgggcgctgcgggcggggcacgctcctcgccttcgccgcgtggaccgcgggctgggtgctggcggccgcgctgctgctccgcgcgcacccgggtgtcctctccgagcgctgcaccgacgagaagagccggcgcatcctggccgcgctgtgccaggactaccagggcggcacgctggccggggacctctgcgaggacctgtgtgtggcgggagagctgctgttccaacgctgcctgcactacaacagaggcaagaaggtgctgcaggccgactggcgcggccggcccgtggtcctcaagtccaaggaggaggccttctccagcttcccgcccctcagcctgttggaagaggaggcaggggagggtggccaggacatgcccgaggccgaactcctcctgatggtggctggggaggtcaagagcgctctgggcctggagttgtccaacagcagcctggggccgtggtggccgggcaggcggggcccacgctggcggggacagctggccagcctgtgggccctgctgcagcaggaggagtacgtctacttcagcctgctgcaggacctgagcccacacgtgctgcccgtgctgggttcctgcggccacttctacgcggtggagttcctggccgcgggcagcccccaccacagggcactcttccccctggaccgggccccaggtgcccctgggggtggccaggccaaggccatcagtgacatcgcactcagcttcttggacatggtgaaccattttgacagtgacttttcccaccgcctccacctctgcgacatcaagccggaaaactttgccatccggagcgacttcacagtggtggctattgatgtggacatggccttttttgaacctaaaatgagggaaatccttgagcaaaactgcacaggagatgaagactgcaatttctttgactgtttttcaagatgtgatttacgagtcaacaaatgcggagcgcagcgcgtaaacaacaacctgcaggtcatctgtgacaaaatatttcgccattggttttccgcgcctctcaagagctctgcggtctctttccagcttcagctgcagttacaggaggcggtgcaggaatgtgcagaccctggggtccccagtgggaacacccggagagcagcctccagcgtgttctggaagcttcgccaactcctccaagccacactgagggagctgcaggaggcagagaagtagccactctctggccttaaacatgctcacacaggaaaagtgaccttggctggatttcttctgccattgttttaaagatgagccatttcccctgtgctctctggggtgccgttctggtctccacattgtggagtggcaagtgctgctgccagagacagtgctccctcgctctcgtcccaccctggcctctgacctgtcgccttgtgtaaaatgagatgagggaggaggtacagacctcccttcaggagggctctcggtcagaagacaccaacctgtgtgcacttattctctgcagagagcacttgtacctggttatcccagcacgagttccagctgttctttcctgtaaatcgttaccacgttaaaaagtgtgcgtgtgtgcatacaaatgatgtgtatgcctgtgtctgggtgcaaatgagcatgtgagcatgtgtgagtgtgcccatgagtgtctgcatgtgtgtgagtgtgcacaggtgagtgtgcacaggtgagtgtggtgtgctcatgaggagtatgagtatgcctgagtgtgaatatgtatgagtgtgaatgagtgtgtgcacatgagtgcacgggtgtcagcatgtgtatataagtgtgggcatgtgtatgtgattgtgtgagtgtgggcaggtgagtgtgttggggatgtgggttagggtggggagtggtgctttctctagtgtgtcctccggaacatcttgcctacctagcaaagaagtgtgaccattctttcggaattaaatacaataaaaagaaaataagctgcatctttagggaagggaatttgcattggagagcgtgtgtaacggcagcttatagtatttttcattttgtggaatccaccaaggttatggatgggttttagggcgcctcgtattgcaatacaccttcccctgggcagggacttgtaggttggcttgatgcagcattgtcttcaccttcagagaaaatttaaagtagagcaaatgctgaggtctgcattgactccaggcaggaccagagaccagcacctttcttttgatggattgaagaccaagtgataggcatcaaatcctatggtggcatgatacgctcatcagtggtgatcccaaggaggcttttccagcaaaatacaggcagggggacaggccaggtgaagccagtgagctttcacttaaagggacctggtttctacccataactgtgacccacgagtgctcaacaaaccaacgggtcaccccttttcagaaatcccatgaaaagggaaatcgagaaagatgagagaatcaggaagtcatgttggcagtttacacattaaagaagacaaattaatcggacgttgtgaaagtcacaaactgacacattccaaatggtctcttatcttggcctgcagcccctttctaaaccagagaaacgggaatgccttcttccagactttggggtcacatttactgactctgcccttcagggcacgctgagaaatggtgtgtgagggactagcatgatcagaggcccccagctctaaattctgccttccccaaagacctgttggaaggcccactgccagctgttattcttacccatcaccactggggatcttccaaatgacacagagttccatagagggcctcctcatcatggacatgaagactcgctttgcaattgtattctagcaagaaggaaaaaacccatgtcagtcaccctgtggcacgagcaaattaaaaccaaagttcaacggccaggcctaggactagtggattccaaaggaaagggcgggcttcgggctattgggtggaggctccgattttccccagagctgcgctgggtgcaatgcctttctgtggtggtcggggcatactttgggccatgctcaccttctaggcaggttctctacaagcaaaaaggtttacaggaagacgggtgtgagatggagggggggaaggagggaagccaccagggctttgccctctgtgccctttaaacagtggggtttcgctctgggaggtcagagtgggtcttttgtgggtagacgctgggatgccagccattcattagtggcctgagctcactgaccaggcagcaaagccagcctggaaaagagaaatagttagttttcatttcaaccaaaatggaaacaaattgtttttgtttacgatggagactgtgcaatatataattatccaacacaattgtggttttattgctgaaagggagctgttttatctcttccctttatgtttggctacacagttacacacacacacacacacacacacacccttttccatccctgcctgggaattcccattagagcagtggctctcaaattgtggtgaagctcagttttgtttttaattttgaaaccttgcaaatcaatgcttttatataacataataaattaacactgtgtatatcaa

SEQ ID NO: 132847 - DNA, 1329 bp, Homo sapiens
  Payload ID: 5954
  Gene Symbol: FAM69C
  Gene Name: family with sequence similarity 69, member C
  Uniprot ID: Q0P6D2
  ENST ID: ENST00000400291
  CDS Start-End: 194-556
ggacgcccgagagtttgtgcagcctgggagacggcggggggtttgattcaggggtgcccgtgggaaggggagggctgggtcgtcccagaacctactgactgtcctcgacccccgactctctgcatgctccggatctcactcccgggagggcccggagaaaacccaagttggggtggtggctattgatgtggacatggccttttttgaacctaaaatgagggaaatccttgagcaaaactgcacaggagatgaagactgcaatttctttgactgtttttcaagatgtgatttacgagtcaacaaatgcggagcgcagcgcgtaaacaacaacctgcaggtcatctgtgacaaaatatttcgccattggttttccgcgcctctcaagagctctgcggtctctttccagcttcagctgcagttacaggaggcggtgcaggaatgtgcagaccctggggtccccagtgggaacacccggagagcagcctccagcgtgttctggaagcttcgccaactcctccaagccacactgagggagctgcaggaggcagagaagtagccactctctggccttaaacatgctcacacaggaaaagtgaccttggctggatttcttctgccattgttttaaagatgagccatttcccctgtgctctctggggtgccgttctggtctccacattgtggagtggcaagtgctgctgccagagacagtgctccctcgctctcgtcccaccctggcctctgacctgtcgccttgtgtaaaatgagatgagggaggaggtacagacctcccttcaggagggctctcggtcagaagacaccaacctgtgtgcacttattctctgcagagagcacttgtacctggttatcccagcacgagttccagctgttctttcctgtaaatcgttaccacgttaaaaagtgtgcgtgtgtgcatacaaatgatgtgtatgcctgtgtctgggtgcaaatgagcatgtgagcatgtgtgagtgtgcccatgagtgtctgcatgtgtgtgagtgtgcacaggtgagtgtgcacaggtgagtgtggtgtgctcatgaggagtatgagtatgcctgagtgtgaatatgtatgagtgtgaatgagtgtgtgcacatgagtgcacgggtgtcagcatgtgtatataagtgtgggcatgtgtatgtgattgtgtgagtgtgggcaggtgagtgtgttggggatgtgggttagggtggggagtggtgctttctctagtgtgtcctccggaacatcttgcctacctagcaaagaagtgtgaccattctttcggaattaaatacaataaaaagaaaataagctgca

SEQ ID NO: 132848 - DNA, 2305 bp, Homo sapiens
  Payload ID: 5955
  Gene Symbol: FAM71A
  Gene Name: family with sequence similarity 71, member A
  Uniprot ID: Q8IYT1
  ENST ID: ENST00000294829
  CDS Start-End: 405-2189
agagagggtcgtcacttcctgtcactaggactacagtttgtagtctctctcagggagagagactacaaactgtaattaaaaaaatcagaggtggaggtcagggggttaggtccagaagaaaacctctctggagcccaccctgcatctctacgtcttggaagagtctggagtccaggcaccctacagcaccccccacagcaatcatccgtgctcccacccccaccccggcctctgggaggctctgaggcaacagtgggggcctgtggggtggggtgggattgagagaccagctgcagagacatctttgtgacccaggagcaccactggtccctcatctgccaccgaggccaaggaagacccagagacctgcctcaccagtgctgccgttgtgctgaaagacaaccatgaatgctgattttctgctgccgtattatacggcccagagtggctccagcatgagcatgttcaacaccaccatggggaaactgcagcgacaactgtacaagggggagtacgatatattcaagtatgcaccgatatttgagagcgactttatccagatcaccaaaaggggagaagtgattgatgtgcacaaccgtgtccgtatggtgaccatgggcattgcacgtaccagccccatcctcccactcccagatgtcatgctactggcacgaccggccaccggctgcgaagagtatgctggacatggccaggccaccaagagaaaaaaacgcaaggcagcaaagaacttagagctcaccaggcttctgcccctgaggtttgtacggatctctgttcaagaccatgagaaacaacagctgcgcctgaagttcgccactggcagatcttgctatctgcaattgtgtcccgctcttgacacacgggatgacctctttgcctattgggaaaaactaatttacctcttgcggccacccatggagagtaacagcagtacctgtggcattccagctgaagacatgatgtggatgcctgtgtttcaggaagacaggaggagcctgggagccgtgaaccttcaaggaaagggggatcaggaccaggtcagcatccaaagcctccacatggtctctgaggtgtgtggggccacctctgctgcttatgctggaggggagggactccaaaatgactttaacaaacccactaatgtgctcaatgcatccatccccaaaacatctacagaacttgctgaggagccagcaacaggggggattaaagaggcagcagcagcaggggcagctgcaggggcagcaacaggcaccgtagcaggtgccttgagtgtggcagcagccaattctgcccctggacaggtgagcgcagccatagctggggcggccaccatcggtgcaggaggaaacaaaggcaacatggcccttgcaggcactgccagcatggctccaaacagcacgaaggtggctgtggcaggggctgcaggcaagtcctcagagcatgtttccagcgcatccatgagcctttcccgagagggcagtgtgagcctggccattgcaggagtagtactgaccagcaggacagctgcagaagcagacatggatgcagcagcgggacctcccgtctccacccggcagagcaagagcagcctgagtggacagcatggaagggagcgaacccaggccagcgctgaaggctgcaaggaggggagggaaagaagggaaaaggacagggctctcggaaggagttcccatcgccgcaggacaggtgaaagccgccacaaaacaaggggagacaagattgcccaaaagtcctccagcaggtcctcattcagccacagagccaatagagatgacaaaaaggagaaaggctgtggcaacccggggagcagcaggcacagggactcgcataaaggtgtcagccacacgcccatctcaaaggagtccaggacctctcacaaatctgggaggagcttatggaccaccagttccggttccagcaagggacttggcagggtcagctctttcctgaggaacgtcagagccaaccttactacaaaagtagtgggcacaccacatggcagagatgtgaacgtcatggctaagatggcggagaggagcaccaacgtggccatcgccgagacagcagagggtggccaggggctggagacggttggttctatgacaccggacatcatggagacagtgacctttgaagcccattaaataagacccagagctggaagctgcaaaggagcccagagctcatgggagtgtccctggaaagcctattccagcgttctttactgccgtttaaataaagaatcatacatctgaaagtg

SEQ ID NO: 132849 - DNA, 2515 bp, Homo sapiens
  Payload ID: 5956
  Gene Symbol: FAM71B
  Gene Name: family with sequence similarity 71, member B
  Uniprot ID: Q8TC56
  ENST ID: ENST00000302938
  CDS Start-End: 97-1914
agaagtcctgtagggagatgggcagttaccttctctccgtctctctctcggggactctatttgtggctggtggagctgtcttaaacgaagagaaccatgagcaatgaatcttgtttaccttattacacagcccacagctactcttcaatgagtgcgttcaaaacctccatgggggacctgcaacgacaattgtacaacagaggagagtacaacattttcaagtatgcaccaatgttcgagagtaattttattcagataaacaaaaagggagaggtgattgatgtacacaaccgtgtccgaatggtgacagtgggcatcgtctgcaccagccccatcctcccactgcctgacgtcatggttctggcccaaccaactaaaatctgtgaacagcatgtcagatggggccggtttgccaaggggagaggtcgcaggcccgtcaagactctagagctcacgagactgcttcccttgaaatttgtgaagatctccatccacgatcatgagaaacagcagctgcgcctgaaactcgccactggccgtactttttatctgcagttgtgtccctcttctgacacacgggaagatctcttttgctattgggaaaaacttgtctatctcctgaggccaccagtagagagttactgcagtaccccaacacttctatctggggacgcaccacccgaagacaacaaaagcctagtggctgcagagctccacagagaaggggatcagagtgagactgggctctacaagccttgtgatgtatctgcagccacctcttctgcttatgctgggggagagggaatccaacatgcctcccacggaacggctagtgcggcttctccatccacgagcactccaggggctgctgaaggaggagcagcaaggacagcaggtggcatggcagtggcaggaacagcaacaggacctagaacagatgtggcaatagcaggggcagcaatgagtcctgcaacaggtgctatgagcatagcaacaaccaaatctgcaggcccaggtcaagtgaccacagcgctggcgggagcagctatcaaaaatccaggagaaaatgaatccagcaagtccatggcaggtgctgccaacatatcctcagagggtattagcttggccttggtgggtgctgcaagcacctccttggaaggtacttccacctcgatggcgggggccgccagtctctcccaagacagcagcttgagtgcggcgtttgcaggcagtattacgaccagcaagtgtgcagcagaaagaactgaaggaccagcagtgggacccctcatctccaccttgcaaagcgaaggctacatgagtgaacgagatggaagccagaaagtttcccagcccagtgctgaagtctggaatgaaaacaaggaaagaagagaaaagaaggacagacatcccagtaggaaaagttctcatcaccgcaaggcaggtgaaagtcaccgcaggagagcgggggacaagaatcagaaagcgtcttcccaccggtccgcatctggccataaaaacacgagagatgacaaaaaagaaaaagggtacagcaacgtaaggggcaagcgacatggctcctctcgcaagagctccacccacagctccaccaaaaaggagtcgagaacaactcaggaactggggaagaaccaatctgcatctagcacaggagctttacaaaagaaagccagtaagatcagctcttttttaaggagcctcagggccactcctggttcaaaaacaagggtcacatcacatgacagagaggtagatatcgtggctaagatggtggagaagcaaaacatagaggccaaagtggagaaagcccagggtggccaggagctggagatgatcagtggcactatgacatccgagaagacggagatgatcgtctttgaaaccaaatccatttaaagaggagccagggctacaaccgcccagggatctggaagtatccctagaggagcccatcccagctttctttactgcagttcaaataataaaggaaatcgtacaactccaaaagaaatacaatctcctgcttgaatttttctgcccatagcctggtggtgacctcacagtggcttctgtgatggtggctatgctacagctggagaccccagcctccaggcaagtagagctccaccacccgcccacggccagcagagccaacgtgagtgttcagctttgcctcaatcccttttgcttccccgagactgtcaaagccacagactaagagctgggatgcatggccaccaccatgtcccctcgcccattctcctcttttccctgaatgcccctgaacatggacattcagtccagttcttagcctatgcagagacaggattcacatcccctcaggggatattcagggtaggaaggagcaatacagcagtatttgtaggcaattagaataggaaatctattcttctagatcaggaattggcaaatcatgttctgaggtccaaatcttaccagctgcctggatttgtaaataaagttttattggaacata

SEQ ID NO: 132850 - DNA, 1796 bp, Homo sapiens
  Payload ID: 5957
  Gene Symbol: FAM71C
  Gene Name: family with sequence similarity 71, member C
  Uniprot ID: Q8NEG0
  ENST ID: ENST00000324341
  CDS Start-End: 423-1148
agcagtggatggttcaggttgggaagaagagcagtgggattgccagttaaggttgtggaatcaaagagcaaaggctgttgtgaagtggaatatcaggctcaaatggaggtccctcccgaatgagcactgacacctgtgtgcccggacatccacgagggccccaacacctgtgctcctgacagctccatgcactaagcagggcacagtctggatccaggggactgactgtctctggcattgagcggttggtaatcaataccccaccctccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtgggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtaagcaccaccacaggtaccatggatgtggctgcaaccaagtctgcagactcaggagagaaacacagcactggcaaaagcagccttcagaggtccaggaggaagtatagccagcatggctattagtgggtgcttccatgtcttaatcttgttatagcaagggctgcatgcacattcttgtcctaaaagggtacttcaagcatatcagtaagtgctactggcctctccctagagagcagtatgaatgtggtggctacaggagcagagagatactgagaaggctgttgcattgacagtatctctctgctactcaaaggctgactctctgctactcagcattgggagtcagttatctcaactctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactc

SEQ ID NO: 132851 - DNA, 1754 bp, Homo sapiens
  Payload ID: 5958
  Gene Symbol: FAM71D
  Gene Name: family with sequence similarity 71, member D
  Uniprot ID: Q8N9W8
  ENST ID: ENST00000311864
  CDS Start-End: 255-1523
actaagtggttagttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggaaaaattgaaaaacattctgaagcctgggtgtttacaagatacaaaaagtaagagtgagttgaaagaatcctcaaaacatgtcaccatctcaaacataacactgacttttgaaggtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatcattacg

SEQ ID NO: 132852 - DNA, 1651 bp, Homo sapiens
  Payload ID: 5958
  Gene Symbol: FAM71D
  Gene Name: family with sequence similarity 71, member D
  Uniprot ID: Q8N9W8
  ENST ID: ENST00000534174
  CDS Start-End: 223-1425
aaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggaaaaattgaaaaacattctgaagcctgggtgtttacaagatacaaaaagtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatca

SEQ ID NO: 132853 - DNA, 552 bp, Homo sapiens
  Payload ID: 5958
  Gene Symbol: FAM71D
  Gene Name: family with sequence similarity 71, member D
  ENST ID: ENST00000530728
  CDS Start-End: 320-552
agttgcctgctgagtagacataaacacctgctaaagaaatgtgaaaagagtggaaacgtgctatttggaggttattttcctagtcgacatccaggagatctccagagatctatttcagccccacctgttggctctcgctctgatgcccaggctggagtgcagtgacaagatcatagctcactgtagcctcaacctcccaggctcagatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccag

SEQ ID NO: 132854 - DNA, 543 bp, Homo sapiens
  Payload ID: 5958
  Gene Symbol: FAM71D
  Gene Name: family with sequence similarity 71, member D
  ENST ID: ENST00000524532
  CDS Start-End: 348-543
aacaatgcccagagcagcctggcctgtgcttcttttactaagtggttagttgcctgctgagtagacataaacacctgctaaagaaatgtgaaaagagtggaaacgtgctatttggaggttattttcctagtcgacatccaggagatctccagagatctatttcagccccacctgttgtttcatttcttctacctcaaccagaacaagctgaaaagccgagagacttaacacctgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataacc

SEQ ID NO: 132855 - DNA, 350 bp, Homo sapiens
  Payload ID: 5958
  Gene Symbol: FAM71D
  Gene Name: family with sequence similarity 71, member D
  ENST ID: ENST00000557671
  CDS Start-End: 1-215
gtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagtgagcccaaattatgggcttatctctgattctttgatattttttccaagatgaaaagagacaaaggatagagattcaagaaaagaagagaaagaaaaatcacataaaatattgggagtttccttcctacccttacccatctttcttttccatgttcctcttaaatattacaaaccaaattccttggaa

SEQ ID NO: 132856 - DNA, 2136 bp, Homo sapiens
  Payload ID: 5958
  Gene Symbol: FAM71D
  Gene Name: family with sequence similarity 71, member D
  ENST ID: ENST00000556046
  CDS Start-End: 225-485
aacagctcagctcagacatagacagcagcctcggactccgcttcacctacccagtatacttacaagaactctaactctttctgaggccttgacctcacacttgaaataacaatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccagccagctcccctcagggcctcacatctaaacaggacaatgatagctgccagcagtagaagatattcatctcatcctggtggctctgtctcctggtggctctgagaaacgttttccagggttggaggatacctcctgtatgtcttgctggtcacatgccactgctgaaaccagtcactggcaaggggtgtggagtggaaccaccactacccatttaagttaatcaggatttaatccctgagctgggtcatcatccctgagccatgatattggacaaaaccaggattctgttaatccagaagaagaggggcacagtttgggtcaacagaagaggtgaatccatttaccttcataaccgagccaactgggtgaccgtaggcatctgtttttccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggaaaaattgaaaaacattctgaagcctgggtgtttacaagatacaaaaagtaagagtgagttgaaagaatcctcaaaacatgtcaccatctcaaacataacactgacttttgaaggtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcaggtatggaacaaattccactacatgttttattgtgatccctggtattcagtagtcatctctggttcctagaagagtagtgtggctaagagcaaaggaattcagctagactttttgatgcatttcctttcttcactatgctccattctgagaatcctatactgaagaaactctttctcaaagccgatcctcaggctatctttcaagtggaaaacattatggcttgtatagtttttcagtttttcccctgattagcatttctttccccattttcactctcctctaaatcacctgttccccttccatacacttttactctcacttaacaccctgtaccccaagaaaagcaaagactggctgaatcttaatacctcattttattaaatgtaattggagtacaaattaaaaa

SEQ ID NO: 132857 - DNA, 359 bp, Homo sapiens
  Payload ID: 5958
  Gene Symbol: FAM71D
  Gene Name: family with sequence similarity 71, member D
  ENST ID: ENST00000556117
  CDS Start-End: 1-157
cccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggagcttgagaactgaatcaaacacttcaggcttgtatagtttttcagtttttcccctgattagcatttctttccccattttcactctcctctaaatcacctgttccccttccatacacttttactctcacttaacaccctgtaccccaagaaaagcaaagactggctgaatcttaatacctcattttattaaatgtaattggagtacaaattaaaaa

SEQ ID NO: 132858 - DNA, 1589 bp, Homo sapiens
  Payload ID: 5958
  Gene Symbol: FAM71D
  Gene Name: family with sequence similarity 71, member D
  ENST ID: ENST00000524914
  CDS Start-End: 241-411
tgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccagctgctcagctgatttcacagaggggtgacaagggaggacaacagacacttcaaaaggcaagaagaggatggcaggagctcttttgccatggctaccaggccgatctccgagcggaaccaggatgccactgtgtacgtggggggcctgaatgagaagttgcagcaattgaagccatgaatgggcagtacctctgtaaccaccctatcaccgtatcttatgccttcgagaaggactccaagggtgagcgccatggcttagcagctggacgacttctggcagctcagaacccgctctcccagcctgaccgccctcatcagctgtttgcagatgcacctccttcaccctctgcccccaatcctgtggtatcatcattggggtctgggcttcctccaccaggcatgcctcctcctggctccttcccacccccagtgctgcctcctggagccctcccacctgggatacccccagccatgccccaccacctatgcctcctggggctgcaggacatggccccccatcggcaggaaccccaggggcaggacatcctggtcatggacactcccaagctcacccattcccaccaggaggagtgccccatccagggatgtctcagatgcagctggcacaccatggacctcatggtttaggacatccccattctggacacccaggctctgggggacagccaccaccccaaccaccacctggaatgccttatcctggacctcctccaatgggcatgcccccccgaaggcctccattctgatctcccatgggtcacccaggtcctatgcctccacatggtatgcgtggacttcctccactgatgccccccatggatacactggccctccacaacccacaccctatggctaccagcctctccctccaaccaggcccactccccagccaccagttgcccctcgaggcccgctttggagccctctccctcagtaaattcacattttccttcctcctattacatcttcccaatatcttttcgataccttggaccaatcagagatgctgtagctccttggggctaaggcactaatccctttcagcacccccaccccattcccctttttaatgtaactttttccacaggaggtatttcttttttatgttggtcctgagtattttgcaaatgcacagagaaaataaaactaaactccttgtttaaaaaaaaa

SEQ ID NO: 132859 - DNA, 1790 bp, Homo sapiens
  Payload ID: 5958
  Gene Symbol: FAM71D
  Gene Name: family with sequence similarity 71, member D
  Uniprot ID: Q8N9W8
  ENST ID: ENST00000612183
  CDS Start-End: 291-1559
aacaatgcccagagcagcctggcctgtgcttcttttactaagtggttagttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggaaaaattgaaaaacattctgaagcctgggtgtttacaagatacaaaaagtaagagtgagttgaaagaatcctcaaaacatgtcaccatctcaaacataacactgacttttgaaggtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatcattacg

SEQ ID NO: 132860 - DNA, 653 bp, Homo sapiens
  Payload ID: 5959
  Gene Symbol: FAM71E1
  Gene Name: family with sequence similarity 71, member E1
  ENST ID: ENST00000602178
  CDS Start-End: 73-653
gtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaaggagaacggacacctgcaactcttcggctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaa

SEQ ID NO: 132861 - DNA, 1225 bp, Homo sapiens
  Payload ID: 5959
  Gene Symbol: FAM71E1
  Gene Name: family with sequence similarity 71, member E1
  Uniprot ID: Q6IPT2
  ENST ID: ENST00000595790
  CDS Start-End: 359-1054
gcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaa

SEQ ID NO: 132862 - DNA, 443 bp, Homo sapiens
  Payload ID: 5959
  Gene Symbol: FAM71E1
  Gene Name: family with sequence similarity 71, member E1
  ENST ID: ENST00000593796
  CDS Start-End: 1-443
cctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcggctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaacaa

SEQ ID NO: 132863 - DNA, 1281 bp, Homo sapiens
  Payload ID: 5959
  Gene Symbol: FAM71E1
  Gene Name: family with sequence similarity 71, member E1
  Uniprot ID: Q6IPT2
  ENST ID: ENST00000600100
  CDS Start-End: 366-1109
ctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacagttctgccccgacatctatcctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaac

SEQ ID NO: 132864 - DNA, 844 bp, Homo sapiens
  Payload ID: 5959
  Gene Symbol: FAM71E1
  Gene Name: family with sequence similarity 71, member E1
  ENST ID: ENST00000599206
  CDS Start-End: 103-609
ataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagaggtgctggaggatgtagatggggagggtgatgatgatgaggtggaggcccagagggagtgggaggagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaacc

SEQ ID NO: 132865 - DNA, 3191 bp, Homo sapiens
  Payload ID: 5960
  Gene Symbol: FAM71E2
  Gene Name: family with sequence similarity 71, member E2
  Uniprot ID: Q8N5Q1
  ENST ID: ENST00000424985
  CDS Start-End: 195-2963
agacccctgctgtccaccctggcagggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatccccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccgaagcgcctgcctccacctggcacctgcaggaccagcccatcagcagacatgcagtcagggttgctgagcgcaactttccgcataagacggtggctgctcagagacagaggaaggccaaggcgctcaagcgcagtttcaagtctcaggccgtgggcgactctgtgcccctcatctggtcgcagctggagcatgctgacgtcaggaagaaacctgcagaaaagaagtcccactcagacccccgccccgacagaactcacacccaaatccgcttgcctgagaagaccagcatcaccacctggaccatcttcagcatcatttccagcaccgccaaccagacacagtcctctccaaaggcctgcacatctgcatctgatgaagccacaggccagggacatgtggttgagagcccttcacactgtgtctcagctgacagccctgatggcttctttctgggctcctgcagctccctggacccgtgcctgtggcatcaggacacggaagacctcatggactctgggggcagcactttgtcgtctgctgcctccggtctggctccctatcccccggctgcctgcctctccacaccctactcttccatccccaggggcagggaaaaggccgggcctatgggctcccaccaggggccggggccaccaccctgccagaaggccccatctggccttgtcacatcttgtaaggcaccgttccttgttgaccagtcccagaagctcccagctgtacctgcttcatcgtggaaacccccacctggattggctcctccccagaaggccccagctgcgtcagctcctccccggaaggccccagctgtacctgctccatcccagaaggccccagccgtacctgctccatcccagaaggccccagccatacctgctccatcccggaaggcctcagctgcgtcagcttctccccgaaaggcctcagccgtacctgccccaccccagaagaccccacccccatctcagaaggccccatctgtacctaccattccccagaaggctgtgtcccccactgctccaaagaagaaatctctactcctccctgccccatcccagaaggctctgccaacctcacctaccgaataccagatggcgctgagcccgcctgcctcacgggggaagctccctggcgattttgacgtgttgccaacaggaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccaaggaggtgaccctggaggccttcaggggccaggggaagttggaggactgggcccactgggcgaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagccctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagcagccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggtcgtcttcagaaattcttttgcccatgctcttagaacttgaaactgtgaggaacacggccaccaaggcagaggagatacaggaggaatcgggcgtcttgaaccttctgcccagcctgcagcactcccagcactccgagtggccggatgcgggggcttaacctcagttggaaactgtccagaggagcccagcgctgccaggccccgagggttctgtgcgcaccgactgtaggaagcggaatgttgaaagccgcttggggggatttgccccctctggtagataccagaactatggatatgcctttatatattggggggcgggggggggcgggggcgagcccgtggagccgcccaacttcgcagagattaaagcttgagcctgagactca

SEQ ID NO: 132866 - DNA, 3188 bp, Homo sapiens
  Payload ID: 5960
  Gene Symbol: FAM71E2
  Gene Name: family with sequence similarity 71, member E2
  ENST ID: ENST00000585734
  CDS Start-End: 187-378
gctgtccaccctggcagggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatccccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccgaagcgcctgcctccacctggcacctgcagtcagggttgctgagcgcaactttccgcataagacggtggctgctcagagacagaggaaggccaaggcgctcaagcgcagtttcaagtctcaggccgtgggcgactctgtgcccctcatctggtcgcagctggagcatgctgacgtcaggaagaaacctgcagaaaagaagtcccactcagacccccgccccgacagaactcacacccaaatccgcttgcctggtaagatcaacccaccccaccccttgccacagtgtgtggctctggttcctgccccaaagggctcagacggctcccccatccagagaagaccagcatcaccacctggaccatcttcagcatcatttccagcaccgccaaccagacacagtcctctccaaaggcctgcacatctgcatctgatgaagccacaggccagggacatgtggttgagagcccttcacactgtgtctcagctgacagccctgatggcttctttctgggctcctgcagctccctggacccgtgcctgtggcatcaggacacggaagacctcatggactctgggggcagcactttgtcgtctgctgcctccggtctggctccctatcccccggctgcctgcctctccacaccctactcttccatccccaggggcagggaaaaggccgggcctatgggctcccaccaggggccggggccaccaccctgccagaaggccccatctggccttgtcacatcttgtaaggcaccgttccttgttgaccagtcccagaagctcccagctgtacctgcttcatcgtggaaacccccacctggattggctcctccccagaaggccccagctgcgtcagctcctccccggaaggccccagctgtacctgctccatcccagaaggccccagccgtacctgctccatcccagaaggccccagccatacctgctccatcccggaaggcctcagctgcgtcagcttctccccgaaaggcctcagccgtacctgccccaccccagaagaccccacccccatctcagaaggccccatctgtacctaccattccccagaaggctgtgtcccccactgctccaaagaagaaatctctactcctccctgccccatcccagaaggctctgccaacctcacctaccgaataccagatggcgctgagcccgcctgcctcacgggggaagctccctggcgattttgacgtgttgccaacaggaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccaaggaggtgaccctggaggccttcaggggccaggggaagttggaggactgggcccactgggcgaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagccctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagcagccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggtcgtcttcagaaattcttttgcccatgctcttagaacttgaaactgtgaggaacacggccaccaaggcagaggagatacaggaggaatcgggcgtcttgaaccttctgcccagcctgcagcactcccagcactccgagtggccggatgcgggggcttaacctcagttggaaactgtccagaggagcccagcgctgccaggccccgagggttctgtgcgcaccgactgtaggaagcggaatgttgaaagccgcttggggggatttgccccctctggtagataccagaactatggatatgcctttatatattggggggcgggggggggcgggggcgagcccgtggagccgcccaacttcgcagagattaaagcttgagcctgagactca

SEQ ID NO: 132867 - DNA, 1718 bp, Homo sapiens
  Payload ID: 5961
  Gene Symbol: FAM71F1
  Gene Name: family with sequence similarity 71, member F1
  Uniprot ID: Q96KD3
  ENST ID: ENST00000315184
  CDS Start-End: 54-1088
ggagacagagatcccaggacaaatgtgcagcaggcccctgagcatgtgtagaaatgttgtcatcatttccacatagaaagacttggaggaaatcaaagaagacagtaaaagtcacaagatcctatccaaccttcccttccctgaatgcctgggaagaattcaggggcctcttgcctgtggatggagagccgaaccctggagcgggcctaggtgtggaggagggactgctctgccgggtggttcattctccagaattcaacctgtttcttgactccgtggtgtttgaaagcaacttcatccaggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagaggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgagtttcaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcgtcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaatgttttcttccctgctcagaccattctggacaaatgtgaactgccagacaccttccatttccctttctatctgtttttcttgctagttcctgtcttctgattaaagcttcattccttctt

SEQ ID NO: 132868 - DNA, 404 bp, Homo sapiens
  Payload ID: 5961
  Gene Symbol: FAM71F1
  Gene Name: family with sequence similarity 71, member F1
  ENST ID: ENST00000466842
  CDS Start-End: 1-404
aggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgagtttcaggagcagcagaaaggtggagac

SEQ ID NO: 132869 - DNA, 1574 bp, Homo sapiens
  Payload ID: 5961
  Gene Symbol: FAM71F1
  Gene Name: family with sequence similarity 71, member F1
  Uniprot ID: Q96KD3
  ENST ID: ENST00000485070
  CDS Start-End: 345-1076
cttttcccccttctcaccggccaggatgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacaggtgctggagcaggggtgtgatctgaatgaccagagggaaggactgatggaattggatggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcgtcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaac

SEQ ID NO: 132870 - DNA, 1818 bp, Homo sapiens
  Payload ID: 5961
  Gene Symbol: FAM71F1
  Gene Name: family with sequence similarity 71, member F1
  ENST ID: ENST00000484425
  CDS Start-End: 405-836
caccggccaggatgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacaggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgaggaaccagttggaccagcagttcagaggcagaacaaattccctttctttctgagcactggtaataaactgaaaaccagtacagcttggaggaggcaagcgcttatagcaacgaagagctcgcaaagacatgggcccaagtcattgctctgactgcacccttgagcatatcgaaacctgggggctcagtcttcagatctgtaaaatggaaatgaaaatagtgccaacgccatccagatgtcaggatccaatgagctcatatgcaccaagcacttagaatgctactcagcagatttagaggcaaattgagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcgtcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaa

SEQ ID NO: 132871 - DNA, 1201 bp, Homo sapiens
  Payload ID: 5961
  Gene Symbol: FAM71F1
  Gene Name: family with sequence similarity 71, member F1
  ENST ID: ENST00000471558
  CDS Start-End: 54-914
ggagacagagatcccaggacaaatgtgcagcaggcccctgagcatgtgtagaaatgttgtcatcatttccacatagaaagacttggaggaaatcaaagaagacagtaaaagtcacaagatcctatccaaccttcccttccctgaatgcctgggaagaattcaggggcctcttgcctgtggatggagagccgaaccctggagcgggcctaggtgtggaggagggactgctctgccgggtggttcattctccagaattcaacctgtttcttgactccgtggtgtttgaaagcaacttcatccaggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagaggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgaggaaccagttggaccagcagttcagaggcagaacaaattccctttctttctgagcactggtaataaactgaaaaccagtacagcttggaggaggcaagcgcttatagcaacgaagagctcgcaaagacatgggcccaagtcattgctctgactgcacccttgagcatatcgaaacctgggggctcagtcttcagatctgtaaaatggaaatgaaaatagtgccaacgccatccagatgtcaggatccaatgagctcatatgcaccaagcacttagaatgctactcagcagatttagaggcaaattgagcagcagaaaggtggagaccaacaagaacagct

SEQ ID NO: 132872 - DNA, 1591 bp, Homo sapiens
  Payload ID: 5961
  Gene Symbol: FAM71F1
  Gene Name: family with sequence similarity 71, member F1
  Uniprot ID: Q96KD3
  ENST ID: ENST00000621392
  CDS Start-End: 230-961
ctacgcttttgtgctgtgtgttccctttctaggttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacaggtgctggagcaggggtgtgatctgaatgaccagagggaaggactgatggaattggatggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcgtcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaatgttttcttccctgctcagaccattctggacaaatgtgaactgccagacaccttccatttccctttctatctgtttttcttgctagttcctgtcttctgattaaagcttcattccttctt

SEQ ID NO: 132873 - DNA, 1582 bp, Homo sapiens
  Payload ID: 5962
  Gene Symbol: FAM71F2
  Gene Name: family with sequence similarity 71, member F2
  Uniprot ID: Q6NXP2
  ENST ID: ENST00000434001
  CDS Start-End: 106-1008
ggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagctgtacaggaagcatgactggggaggcctcaggaaacttacaatcaaggcagaaggcaaaagagaagcagacctgtcctacgagtctggagcaggagaaagaaagaagtgggaggtgctatgcacttttaaacaaccaaatctcgtgagaactcactatcatgagaacagcaaggaggaaatccacccccatgatccaatcacctcccaccaggcacctcctccaacactggggattaaattcaacatgagatttgggcagggagacagatccaaatcatatatcagtctgctcagttgaaaccacacaatagccaagcaaagccaagaaagccagtccaaggctggcttggaaagggcctctgaggagaaatcaactttcaaaggggcagggggaaatagaggttgagctactgcaagccca

SEQ ID NO: 132874 - DNA, 1529 bp, Homo sapiens
  Payload ID: 5962
  Gene Symbol: FAM71F2
  Gene Name: family with sequence similarity 71, member F2
  Uniprot ID: Q6NXP2
  ENST ID: ENST00000474069
  CDS Start-End: 107-1009
aggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggctgtacaggaagcatgactggggaggcctcaggaaacttacaatcaaggcagaaggcaaaagagaagcagacctgtcctacgagtctggagcaggagaaagaaagaagtgggaggtgctatgcacttttaaacaaccaaatctcgtgagaactcactatcatgagaacagcaaggaggaaatccacccccatgatccaatcacctcccaccaggcacctcctccaacactggggattaaattcaacatgagatttgggcagggagacagatccaaatcatatatcagtctgctcagttgaaaccacacaatagccaagcaaagccaagaaagccagtccaaggctggcttggaaagggcctctgaggagaaatcaactttcaaaggggcagggggaaatagaggttgagctactgcaagccca

SEQ ID NO: 132875 - DNA, 754 bp, Homo sapiens
  Payload ID: 5962
  Gene Symbol: FAM71F2
  Gene Name: family with sequence similarity 71, member F2
  ENST ID: ENST00000477515
  CDS Start-End: 100-609
gctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccagacccatgtacctgaggctgatttccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcagcctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacct

SEQ ID NO: 132876 - DNA, 5749 bp, Homo sapiens
  Payload ID: 5962
  Gene Symbol: FAM71F2
  Gene Name: family with sequence similarity 71, member F2
  Uniprot ID: Q6NXP2
  ENST ID: ENST00000480462
  CDS Start-End: 107-1036
aggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccagacccatgtacctgaggctgatttccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagtgagtccctaatttttgcaggttgggctatagggaggctccagtttgggaaaggactgactgagaacaggagcagtttttggaaaaataggtgggaaaagttactgtctgtgtgtacagagaactacctgagactgggtaattttatttatttatttatttatttatttatttattttggagatagagtcttgctctgtctccaggctggagtacagtggtgcgatcatggctcactgcaacctccacctcctgggttcaagcaattctccagcctcagcctcccaagtagctgggactacaggcacacactacacctggctaagtttttatattttagtagagatggggtttcaccacgttgcccaggctggtctccagctcctgagctcaggccatccagtcacattggcctctcaaagggttaggattacaggcgtgagccaccaggcccagcctcgagtctgggtaatttataaagaaaagaggtttaattggctcatggttccccaggctgtacaggaagcatgactggggaggcctcaggaaacttacaatcaaggcagaaggcaaaagagaagcagacctgtcctacgagtctggagcaggagaaagaaagaagtgggaggtgctatgcacttttaaacaaccaaatctcgtgagaactcactatcatgagaacagcaaggaggaaatccacccccatgatccaatcacctcccaccaggcacctcctccaacactggggattaaattcaacatgagatttgggcagggagacagatccaaatcatatatcagtctgctcagttgaaaccacacaatagccaagcaaagccaagaaagccagtccaaggctggcttggaaagggcctctgaggagaaatcaactttcaaaggggcagggggaaatagaggttgagctactgcaagcccaaaataaaagaaatcctgagaaggatggtaaccagctggaagattcctttgtgttgctccactatatcaagcaagaaattgagtctttggctgggcgcggtggctcttgcctgtaatcccagcactttgggaggctaaggtgtgcagatcacttgaggtcaggacttcgagaccagcctggccaacatggcaaagccctgtctctacccaaaatacaaaaattagctggatgtggtggtgcacacctgtagtcccagctactcaggaggttgaggcaggagaattgcttgaaccaggaggcagagcttgcagtgagctgggatcatgccactgtgctccagcctgggtgacagagccagactccatctcaaaaaaaaaaaaaaaaaaaaaaagaataaattaggtcttcattgccctgtgttagtgtaaagctatgaaggctcccctggctcatacaacatttcattgctaatgaaaacatggtgaggaagatattgactgcccatcaccagaaattctgattaatttgactgtttcttacccagaacctaatgaaagtgaactggaagacatggcatctttgagtattgggaatggggtaggagctttggccaacctttatacacatagggaatacttacaaggaaaataccatgactcctttttttttttttttgagacagtcttgttctgttgcctaggctggagtgcagtggtgtgatctcagctcactgcaacctccacctctcaggttcaagcgattcttgtgcctcagcctcccaagtagctgggattacaggtgtgaaccaccagtccggctaatttttgtatttttagcagacacagggtttctccatgttggccaggctggttttgatctcctgacctcaggttatccaccctcctcggcctcccaaagtgctgggattacaggcatgagccaccacgcccagccccaccacgcccactccaatatttaataagtatttgtcaggctcctgctaggtgctagacactgcgtttgacgctaagtatattggagagaacaagacagacggacaagttacctgccttgagggagggtctgggagagatgccaagtcctattttggagacatagtgaagccattaatgttgacctgatgtctgagccacccagtctgcaaatgaaagctggaggccctgctttccagcatgtgtggttcacatcctatgtggtgcagaaagaaagaacatggttgccctcctcttgtgcatgctcagttgggctgagcagtcaaatctggctgaattgagtcagaaaagacatctgagttaagaggatgcctgatgcttgttggttttgtcttgcctccagtaaaattaaaaacaagtttcctttcagtatgttacaatcaaataagctgagcattgttggtgctggtgagggacatctagaagctgaacttagaaaagactaatgtgcagggtgattgtacttccaaatgcatgcctgttgtcctggtatcattattaatacatacccatttcactctgagaagtgtccctcagtgaatcacaaatcatgtggccatcctatctatatggcatacttataaacattgaaaggcttgtcatccccacttctttgtcttggtttaagccttcatcagccctcacctagactattgtattaatagtaaccccaggccaggcatggtggctcaggcctgtaatcccagcactttgggaggctgaggcgggcagatcacgaggtcagaagtttgagaccagcctggccaatatggtgaaaccccatctctactaaaaatacaaaaattagctgggcatggtggcgcacacctgtagtcccagctactcgggaggctgagacagaagaatctcttgaacctgggaggtggaggttacagtgagcagagatggcgccaccgcactccagcctgggcgacagagccagattccgtctcaaaataaaataaagtaaaatagtaaccccaattggtctcccagactttatcatcatcatcatcataatagctaacatctttagaaatttgctatcttctaagcactatgctgactttacaaagatcacataaaccacaccacaagccattgagaagtagatcttattattacattttataaatgataaaccggagccacagagaggttcaagaacttgcttaaggtcacacaggtagtaagtagcagagccaggacttgaagccagtctgtctaactccaaaatccaaattactcttgatgcctctccaatgtcttcccaactcattcccttttcatacctctaacagagcaactttttgacacataaatctgacagaaaggaccaggcacggtggctcatacctgtaatcccagcactttggaaggccaaggtgggcagatcacttgaagtcagaagtttgagaccagcctggccaacatggtgaaaccctgtctctactaaaaatgtgaaaattagccaggtgtggtggtgcgcgtctgtagtcccagctactcaggaggctgaggcaggagaatctcttgaactggggaggcagaggttgcagtgagccgagatcactccactgcgctctagcctgggcaacagagcaagattccatctcaaaaaaaaaaaaaatatatctgactgagtttcctccttaataaaaccagaccctttgacatgaaatgactagacccctgcctctctctccagcctctccactggccactgctgccatagaatcttatgctcccaccatgccaaatttcttgtggttccctaaatgcgccatgtttgaagatactttgaggacattgtatatacttttgttctacctgagatacatttgcttactttctccacatattgccctcatgacacttatccttattgatggatttcttcaatgctactattgtgccttacatgtgccttgtattatagcatttttatagcatttctcacccaattgtggctatttgtttacatgtctgtctccttggtggaactgtgaactctgtcataacagatgccattttatgtcagttagacttctttggttgccagtaagagaagctgactctaatctaaaccaaaaggaattcattggacggatgtgggttggctcacaaaatcaaagggacaactgcggagccgatcttggaatgctctgacaccagaacagctctgtgaattcagataggggtagtgaattgaccatttcatcaaatgctgcagcaagctaggtggtttccccaaaggaaattgaggagtgttacaagaagaccattaggggaacggttatctggtggctgataataacaaatttccatggcagtctctttgctctctgttggaagaggtactccaccatgggccttgagcatctctacacatccttgctaagcgtgtcaaatttcaagtcctaactgtcctctgtctctggaggaggagacaggtttggttactgtttgttgtaaaaattactgagcccttcaccatgggtgcctcagctgtatgcaaagccccttgtattgctgggggacagagcaactggtactgccatgctggtgctctggctgtttgctgttggcaataaactattctgttttggttca

SEQ ID NO: 132877 - DNA, 1774 bp, Homo sapiens
  Payload ID: 5963
  Gene Symbol: FAM72A
  Gene Name: family with sequence similarity 72, member A
  Uniprot ID: Q5TYM5
  ENST ID: ENST00000341209
  CDS Start-End: 422-751
ggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacagcgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 132878 - DNA, 2398 bp, Homo sapiens
  Payload ID: 5963
  Gene Symbol: FAM72A
  Gene Name: family with sequence similarity 72, member A
  Uniprot ID: Q5TYM5
  ENST ID: ENST00000367128
  CDS Start-End: 849-1298
ggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaa

SEQ ID NO: 132879 - DNA, 676 bp, Homo sapiens
  Payload ID: 5963
  Gene Symbol: FAM72A
  Gene Name: family with sequence similarity 72, member A
  ENST ID: ENST00000367129
  CDS Start-End: 71-520
ctaggctgggacccgggctgtccgccagggctgggagacactggaggaggccggccgatgattacgcgcgatgccaacgacgactgccctacggtggaccgcggctgcccgtgtgcggaggaaagggagaggcggctgggtgccggctgcgctgcggtccgtgagccaggacggagtcccaggctgtacagtgatgggcggagagactcgcagtcctgagaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctc

SEQ ID NO: 132880 - DNA, 740 bp, Homo sapiens
  Payload ID: 5963
  Gene Symbol: FAM72A
  Gene Name: family with sequence similarity 72, member A
  ENST ID: ENST00000431655
  CDS Start-End: 380-740
agaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtggtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagat

SEQ ID NO: 132881 - DNA, 1139 bp, Homo sapiens
  Payload ID: 5963
  Gene Symbol: FAM72A
  Gene Name: family with sequence similarity 72, member A
  ENST ID: ENST00000607379
  CDS Start-End: 395-550
ctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaagtaagtcatgctagtggcgggcaacggtagcttttaactaaatgggaacacttatggcttggatctgtgggagtcaacaaggaggttatcatttcggtgtttcagccactcccaccagtttgatgatccccttggaatatatctaagtgggcagactgtctggacaaagtctgtggtttagccaaggtggtcagtcctgatgtaatgcttctagttcaattgcagtcatgcgaccacacatctcttaagtttgatccctggttcagtgccctgcccaaccatcctatttcactgaatcaagtccgtggcgtagactttaggtaaattcaggcaaaattttccgtactgttggagaggagaggtcatttaagtttttcatttttatccatgaaattttgcaccaaaaaaaaaaaaatccgttttctatcattatttgcaattggcatcctaaatcagatccgttgttcatcaaattcagttttctttcctcaaaactctctctctctgaaagagatgtaaatagatttttatgggatgaaaaatagagacttagccttaatccttatctccaataaagactattttggacatta

SEQ ID NO: 132882 - DNA, 629 bp, Homo sapiens
  Payload ID: 5963
  Gene Symbol: FAM72A
  Gene Name: family with sequence similarity 72, member A
  ENST ID: ENST00000468509
  CDS Start-End: 99-311
ctgcgcggaacacccatcctcctgggtcctaggctgggacccgggctgtccgccagggctgggagacactggaggaggccggccgatgattacgcgcgatgccaacgacgactgccctacggtggaccgcggctgcccgtgtgcggaggaaagggagaggcggctgggtgccggctgcgctgcggtccgtgagccaggacggagtcccaggctgtacagtgatgggcggagagactcgcagtcctgagaaatcggtgccccagtccctggaggagcctccgccaactccgcaggaccccgccgggaagtagagcccacccctttaccaatcaccgcccgttttctatcgaccgatggggcccatagccaataggaagagctgatcccgagaggcccggaatgagggggaggagctggcaaaacttggaggtgtgactagcactgccgaggcgtggtcacagattaagctccaccccgggttgttgaacccctaagtagaactgatgggcgggattaaggtggaaccgacgaccaaacacaaactcttgagctaaggcacggccaattgggccggggtagagaggaggggtgttgcggggagttttaaccaataaagagtagagaccggt

SEQ ID NO: 132883 - DNA, 1773 bp, Homo sapiens
  Payload ID: 5964
  Gene Symbol: FAM72B
  Gene Name: family with sequence similarity 72, member B
  Uniprot ID: Q86X60
  ENST ID: ENST00000355228
  CDS Start-End: 423-752
ggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacagcgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 132884 - DNA, 2396 bp, Homo sapiens
  Payload ID: 5964
  Gene Symbol: FAM72B
  Gene Name: family with sequence similarity 72, member B
  Uniprot ID: Q86X60
  ENST ID: ENST00000369390
  CDS Start-End: 852-1301
gaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtata

SEQ ID NO: 132885 - DNA, 748 bp, Homo sapiens
  Payload ID: 5964
  Gene Symbol: FAM72B
  Gene Name: family with sequence similarity 72, member B
  ENST ID: ENST00000452190
  CDS Start-End: 380-742
agaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtggtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaa

SEQ ID NO: 132886 - DNA, 1659 bp, Homo sapiens
  Payload ID: 5964
  Gene Symbol: FAM72B
  Gene Name: family with sequence similarity 72, member B
  ENST ID: ENST00000619376
  CDS Start-End: 826-1110
gaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtga

SEQ ID NO: 132887 - DNA, 676 bp, Homo sapiens
  Payload ID: 5964
  Gene Symbol: FAM72B
  Gene Name: family with sequence similarity 72, member B
  ENST ID: ENST00000471903
  CDS Start-End: 71-520
ctaggctgggacccgggctgtccgccagggctgggagacactggaggaggccggccgatgattacgcgcgatgccaacgacgactgccctacggtggaccgcggctgcccgtgtgcggaggaaagggagaggcggctgggtgctggctgcgctgcggtccgtgagccaggacggagtcccaggctgtacagtgatgggcggagagactcgcagtcctgagaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctc

SEQ ID NO: 132888 - DNA, 1658 bp, Homo sapiens
  Payload ID: 5965
  Gene Symbol: FAM72C
  Gene Name: family with sequence similarity 72, member C
  ENST ID: ENST00000369175
  CDS Start-End: 825-1109
gaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtccaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtga

SEQ ID NO: 132889 - DNA, 2297 bp, Homo sapiens
  Payload ID: 5965
  Gene Symbol: FAM72C
  Gene Name: family with sequence similarity 72, member C
  Uniprot ID: H0Y354
  ENST ID: ENST00000584486
  CDS Start-End: 825-1274
gaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtccaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtagtttatcatgtgattgttccatgtagttcctgtcttctttcctgcaacaacagacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaaactaaagcgatttgcttaagccattgtacattataaagagctgttttgttttgctttgctttgctttgttttgttttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 132890 - DNA, 2397 bp, Homo sapiens
  Payload ID: 5966
  Gene Symbol: FAM72D
  Gene Name: family with sequence similarity 72, member D
  Uniprot ID: Q6L9T8
  ENST ID: ENST00000400889
  CDS Start-End: 849-1298
ggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttaccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtccaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacagacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaa

SEQ ID NO: 132891 - DNA, 5288 bp, Homo sapiens
  Payload ID: 5967
  Gene Symbol: FAM73A
  Gene Name: family with sequence similarity 73, member A
  Uniprot ID: Q8NAN2
  ENST ID: ENST00000370791
  CDS Start-End: 33-1931
actcctgaccccggaaggactccgccttctccatgtcagactgctgctcagcgccaggcatcagctgggaagctggcgtgggcaggccagctgtacctggcctggagctccagattagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagcagcatcagacaaaggttcaagttgttccagtagcagacagaatttgacattatctttaagttctaccaaagacaaaggatctcaagtttgtaactatgctaatggaggacttttcagtaaatattcaggttctgcacagagtttggcctctgtccagagtgtcaattcttgtcatagctgcgcttgtggcaattctaattcctgggacaaagcagatgaagatgatattaaacttgttaatattcctgtgactactccagagaacttatacttaatgggtatggaattgtttgaagaggcattgcgtcgatgggaacaagctctgacctttcgcaatagacaggctgaagatgaagcctgtggttccattaaactgggtgcaggagatgccattgctgaagaaaatgtagatgatattattagtactgaatttatccataaactcgaagctctgctgcaaagagcctatcgtctccaagaggagtttgaagctacccttggggcatctgatcctaattcccttgctgatgatattgataaagatacagatatcaccatgaagggtaatgtggaagactttggcctgcgagacaccttgagcatcgcatccacggattcctttgcttccgcagcagagcttgcagaacacagagaagtacggcatacctacagcctggagtccctttgtcactgcccattttacgaggaagccatgcatttagttgaagaaggaaaaatttactccagagtactgagaactgaaatgttggagtgcctaggagacagtgattttcttgccaaacttcactgtattcgacaggcttttcaggtaattctttcagaatcagctaacaggatattcctcgctgagagcggaaggaaaattttatcagctttaattgtgaaagcacgaaagaatccaaagaagtttgaagatgtttttgatgaaatgatctattttttagagcagaccgatcactggggtagtactgaaatggaacttgctgctagaggggtgaaaaatctaaatttttatgatgttgttctggattttatattaatggactcctttgaagatttggaaaacccacccacatccatacagaatgtagtaaataatcgatggctaaactcatccttcaaagaaacagctgtggcttcaagttgttggtcggtgctgaaacagaaaagacaacagatgaagatcccagatggattttttgcccatttttatgccatttgtgaacacatcagtcctgtcctagcctggggctttttgggtcctagaaattctctgtatgatttatgttgcttttttaagaatcaagttcttttatttctcaaagacatttttgactttgagaaggtgcgctattcaagtacagagactttagctgaagacctcatgcagttactcattcgccgcactgagcttttaatggcctatcttgaagcagatgccctgaggcatacaagtagttgtctaagcagtcatggtcatgttatgtccactgggctactggaagccaaagtacaataagtaccataagaatcatacaatttgagtgtgctatgaaatattttaaggtaactattgattttgtaacatatattacaaagttaacagaattgatgcatgtggattcagggaggaaaaaaaaatctactaaaaaatgagcaactgtactgtatttatacagaagttctgtcattgaattcctgtgtagtgtagtcatagtggctttttgcattcattaggtaataattgaagtcatgaaatgtatattttacagaaatatcgcttgaattgaagccaatatttgggagttaattggtttgtcttcttgaagctgtcattctcaaaagctctgtttttatgctttgcacctttaaaatgtacactttagccaaggtctttgtggcccacacatgcaagaatatattacttctaatgtcaatatatttaactttgcctagaaacatatttttaattataaagttattcatttgtttaatcaagtttaggcagtaatgatgtttaatatgtactgcatacattattgcttgtgcatttgcttatgtatttgaatcaaagaaattgtaatcactgaatattgttatagaacatttaaatgggccacttgcagtggctcatgcctgtaatacattgggaggctgaggcaggaggacagtttgaggccaggaggttgagactagcctggacaacataaggagatgcctgtctctacaaaaacataaaaataaattagctggtatcaagcagagttccatggaaatattaaaatttttttaaaaaataaaaataggctgggtgtggtggttcatgcctgtaatcctagcactttgggaggccaaggtgggcggatcacctgaggtcaggtgttcgagaccagcctccccaatatggtgaaaccccgtctctactaaaaatacaaaaattagccaggtgtggtggcgggcgcctgtagtcccagctactcgggaggctgacacaggagtattgcttgaacccaggaagtggaggctgcagtgagccgagatcgcaccactgcactccagcctgggcaacaaagtgagactctgtctcaaaaaataaattaattaaattaaattaattagttgggtgtggtggcatgtgtctgtggtcccagctacttgggaggctgaggtgggaggatcacttgagtccagaaggtcaaggctgtcatgagctgtgattgcatcactgcactccagcctgggcgacagcaagaccctatctcagaagtgaataaataaaacaaatacagcatttaaatgaattgacattgagaaatttacaatttacaaatttatattaactgtagtttccaaaatatgttactgttggtcctgtaagttacaaagagactgaagaactttctttttatacattagagcattttcccctggaatgagtattgattaaaaagataacatttattaattaataaaggcaatttaaaatttagtgttatttgaagactgtcaacatctgaaggtatgaaacttggtacagtgaaataatttctcctttctccttccttttagttattcccacagaaaactcagcccagtgggaatttgtcatattatgcccatgttttaaaaatattcatagtttgaatcttattgacattttaaagaagagttttttcctccctggaatgtaaaacaaaaatattttttaatgatgtggaagtatatatttcatgttcattatgataaatctacaaacaaatgaattgtttttatgggtggagttcttctataagagtatattaaatgctttcagagttgtattaattttgtttctaaataatataccacttatttggagtgactaactcagtatgtaagtagatgagatttgttgattttgcccctaaaacgggctttagtcattttaggagtgagttgcacaaaaggacctaaaatgcattgttttttgccttcttttaagagatggggtctcgctctattgcccaggctggagtgcagtgtgctatcatacatagctcactgcagtctccaactcctcataccagaggcatgtgtcaccatgtcttactcctaaaatgcatttttaaaaagcgaatttttagattaaagtgcctagtttctgattaataaatagaagatgaaaaaagtgggcgggaaaagcataatcttttaagatttgtaattttctgtatgtgccacatttatgtaaattaactataaaatatggaattcaggatcatgctgttttgcatgtactttataggttatatagcatgaaacatacaaattatcactgttctttagtatatagctccttgccttttcttacatagatgcttaatttaacaattacctatttatagttcttattattgacgggaatatgattagaagtaccaaaactaaaaattccattatgtactgtttactttttatttaatattacatgtttttaccttgttgcggtatctttggccttcacacacacatgtgtgcgtgcacgtgcatttcattaccatgtagacaagacagttattgcttatagtaatttacccatttgagggctaagtgttttaagctgtggttttataagcaaagctgtaagtaaatgtaatttattttagaaagatattatttgaaatcaattttgaagaattgcactatttgataatgctgctactacatgagataactctggggaattaattttatgagataagatgaatggctttctagaaggtgttgctttttgttttttctttttcttttttacatttcatcttagaaaaagttgcttatattcagcaggttggtttgtcaaattcagtgtttgagtttgtttctggtcagttcagtagctgctactttagcaagatgtggcctttcacaaaagaggtaagagtgaccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggaggcggaggttgcagttagccgagatcgtgccattgcactccagcctgggcaacaagagtaaaactctgtctcaaaaaaaaaaaaaaaaaaaaaaaaaaa

SEQ ID NO: 132892 - DNA, 6409 bp, Homo sapiens
  Payload ID: 5967
  Gene Symbol: FAM73A
  Gene Name: family with sequence similarity 73, member A
  ENST ID: ENST00000443751
  CDS Start-End: 33-1934
actcctgaccccggaaggactccgccttctccatgtcagactgctgctcagcgccaggcatcagctgggaagctggcgtgggcaggccagctgtacctggcctggagctccagattagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagcagcatcagacaaaggttcaagttgttccagtagcagacagaatttgacattatctttaagttctaccaaagacaaaggatctcaagtttgtaactatgctaatggaggacttttcagtaaatattcaggttctgcacagagtttggcctctgtccagagtgtcaattcttgtcatagctgcgcttgtggcaattctaattcctgggacaaagcagatgaagatgatattaaacttgttaatattcctgtgactactccagagaacttatacttaatgggtatggaattgtttgaagaggcattgcgtcgatgggaacaagctctgacctttcgcaatagacaggctgaagatgaagcctgtggttccattaaactgggtgcaggagatgccattgctgaagaaaatgtagatgatattattagtactgaatttatccataaactcgaagctctgctgcaaagagcctatcgtctccaagaggagtttgaagctacccttggggcatctgatcctaattcccttgctgatgatattgataaagatacagatatcaccatgaagggtaatgtggaagactttggcctgcgagacaccttgagcatcgcatccacggattcctttgcttccgcagcagagcttgcagaacacagagaagtacggcatacctacagcctggagtccctttgtcactgcccattttacgaggaagccatgcatttagttgaagaaggaaaaatttactccagagtactgagaactgaaatgttggagtgcctaggagacagtgattttcttgccaaacttcactgtattcgacaggcttttcaggtaattctttcagaatcagctaacaggatattcctcgctgagagcggaaggaaaattttatcagctttaattgtgaaagcacgaaagaatccaaagaagtttgaagatgtttttgatgaaatgatctattttttagagcagaccgatcactggggtagtactgaaatggaacttgctgctagaggggtgaaaaatctaaatttttatgatgttgttctggattttatattaatggactcctttgaagatttggaaaacccacccacatccatacagaatgtagtaaataatcgatggctaaactcatccttcaaagaaacagctgtggcttcaagttgttggtcggtgctgaaacagaaaagacaacagatgaagcagatcccagatggattttttgcccatttttatgccatttgtgaacacatcagtcctgtcctagcctggggctttttgggtcctagaaattctctgtatgatttatgttgcttttttaagaatcaagttcttttatttctcaaagacatttttgactttgagaaggtgcgctattcaagtacagagactttagctgaagacctcatgcagttactcattcgccgcactgagcttttaatggcctatcttgaagcagatgccctgaggcatacaagtagttgtctaagcagtcatggtcatgttatgtccactgggctactggaagccaaagtacaataagtaccataagaatcatacaatttgagtgtgctatgaaatattttaaggtaactattgattttgtaacatatattacaaagttaacagaattgatgcatgtggattcagggaggaaaaaaaaatctactaaaaaatgagcaactgtactgtatttatacagaagttctgtcattgaattcctgtgtagtgtagtcatagtggctttttgcattcattaggtaataattgaagtcatgaaatgtatattttacagaaatatcgcttgaattgaagccaatatttgggagttaattggtttgtcttcttgaagctgtcattctcaaaagctctgtttttatgctttgcacctttaaaatgtacactttagccaaggtctttgtggcccacacatgcaagaatatattacttctaatgtcaatatatttaactttgcctagaaacatatttttaattataaagttattcatttgtttaatcaagtttaggcagtaatgatgtttaatatgtactgcatacattattgcttgtgcatttgcttatgtatttgaatcaaagaaattgtaatcactgaatattgttatagaacatttaaatgggccacttgcagtggctcatgcctgtaatacattgggaggctgaggcaggaggacagtttgaggccaggaggttgagactagcctggacaacataaggagatgcctgtctctacaaaaacataaaaataaattagctggtatcaagcagagttccatggaaatattaaaatttttttaaaaaataaaaataggctgggtgtggtggttcatgcctgtaatcctagcactttgggaggccaaggtgggcggatcacctgaggtcaggtgttcgagaccagcctccccaatatggtgaaaccccgtctctactaaaaatacaaaaattagccaggtgtggtggcgggcgcctgtagtcccagctactcgggaggctgacacaggagtattgcttgaacccaggaagtggaggctgcagtgagccgagatcgcaccactgcactccagcctgggcaacaaagtgagactctgtctcaaaaaataaattaattaaattaaattaattagttgggtgtggtggcatgtgtctgtggtcccagctacttgggaggctgaggtgggaggatcacttgagtccagaaggtcaaggctgtcatgagctgtgattgcatcactgcactccagcctgggcgacagcaagaccctatctcagaagtgaataaataaaacaaatacagcatttaaatgaattgacattgagaaatttacaatttacaaatttatattaactgtagtttccaaaatatgttactgttggtcctgtaagttacaaagagactgaagaactttctttttatacattagagcattttcccctggaatgagtattgattaaaaagataacatttattaattaataaaggcaatttaaaatttagtgttatttgaagactgtcaacatctgaaggtatgaaacttggtacagtgaaataatttctcctttctccttccttttagttattcccacagaaaactcagcccagtgggaatttgtcatattatgcccatgttttaaaaatattcatagtttgaatcttattgacattttaaagaagagttttttcctccctggaatgtaaaacaaaaatattttttaatgatgtggaagtatatatttcatgttcattatgataaatctacaaacaaatgaattgtttttatgggtggagttcttctataagagtatattaaatgctttcagagttgtattaattttgtttctaaataatataccacttatttggagtgactaactcagtatgtaagtagatgagatttgttgattttgcccctaaaacgggctttagtcattttaggagtgagttgcacaaaaggacctaaaatgcattgttttttgccttcttttaagagatggggtctcgctctattgcccaggctggagtgcagtgtgctatcatacatagctcactgcagtctccaactcctcataccagaggcatgtgtcaccatgtcttactcctaaaatgcatttttaaaaagcgaatttttagattaaagtgcctagtttctgattaataaatagaagatgaaaaaagtgggcgggaaaagcataatcttttaagatttgtaattttctgtatgtgccacatttatgtaaattaactataaaatatggaattcaggatcatgctgttttgcatgtactttataggttatatagcatgaaacatacaaattatcactgttctttagtatatagctccttgccttttcttacatagatgcttaatttaacaattacctatttatagttcttattattgacgggaatatgattagaagtaccaaaactaaaaattccattatgtactgtttactttttatttaatattacatgtttttaccttgttgcggtatctttggccttcacacacacatgtgtgcgtgcacgtgcatttcattaccatgtagacaagacagttattgcttatagtaatttacccatttgagggctaagtgttttaagctgtggttttataagcaaagctgtaagtaaatgtaatttattttagaaagatattatttgaaatcaattttgaagaattgcactatttgataatgctgctactacatgagataactctggggaattaattttatgagataagatgaatggctttctagaaggtgttgctttttgttttttctttttcttttttacatttcatcttagaaaaagttgcttatattcagcaggttggtttgtcaaattcagtgtttgagtttgtttctggtcagttcagtagctgctactttagcaagatgtggcctttcacaaaagaggtaagagtgaccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggaggcggaggttgcagttagccgagatcgtgccattgcactccagcctgggcaacaagagtaaaactctgtctcaaaaaaaaaaaaaaaaaaaaaaaaaaagacatatgtaacggtttccatttgccttaaaattgggttaaatagcaaaagcaatgtctttaaaaatgattagtttagagccttttagggtaaaccctgtttaaacacttaatcatggaattgcccttgccaccatgagctctaccatccacttccatatgtaaattataagagggacttcaattaagtcactcctgagaaaatatccttttttctagaagaaagaagataaattttgaggcaatttacatttggtatttcttttaatttcattttttgtattttaatttccctacatttttgttcaactaagagtgcttatttcttcttgaaggttaacattatgtttattaagtatcaaaatggaattatcttttaaaaaagaagacaagttttccatactgtcacagtaagctccaaagaactttgtctttctcataaagtaatattctttatttgcatccatttactatgattccgttaatttgttgaattaaatgcctttataaaaatatttacaaatgttttcttgccttaaaatgtaacattttctacttaaatttaatttccaagagagtgattatttgcattacaaaggaattcttaataattcctgtaagcctaggaaataggaatgccaaagtaacatttaatgtacttctctataacttttcataatcagaaattttaaattatgtttatataacccatttacttttattttaatgtgaatatatattcagaaattatttgatgtaaatttcaaaatgattataggaattaagctgaattctaatttttttgcttagatttagaaatatgtatgtgaaatttaagaatttatataatctgtgattagtggaaataagaacatccctactttgttcctaatgagtatattatgttattgttttgtttagtttgtgaacaaccatgtattagctttacttagctgatgtcagtaaatgtttctgtctcctaaatgtaaggactgtactcattaatttgtgtaaaagtaaaacactacagtagcagaaaaaattgcactggctctttagccaaaataagcactgtaacatggatgtattactattactgccaaataaaaaagtgatggt

SEQ ID NO: 132893 - DNA, 500 bp, Homo sapiens
  Payload ID: 5967
  Gene Symbol: FAM73A
  Gene Name: family with sequence similarity 73, member A
  ENST ID: ENST00000477627
  CDS Start-End: 301-500
gtgccaccctgaacacccccgacctcgtctcatctcagaagctaagcagggtcgggcctggttagtacttgcataggaaagcaggagggtccccacgccagagggaggcctgcaaaggaagcgcggaattgggatgggctcgccactgctctgagccagaggaagggtctggacggccgagctggagggacccccttttctggtgttcttggcaaagaaaaaggaagacagcagaggagagctccgcgaggggctgctgtggggtcgggggagagcgcgctggagattagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtggaaa

SEQ ID NO: 132894 - DNA, 3637 bp, Homo sapiens
  Payload ID: 5968
  Gene Symbol: FAM73B
  Gene Name: family with sequence similarity 73, member B
  Uniprot ID: Q7L4E1
  ENST ID: ENST00000358369
  CDS Start-End: 227-2008
aggtacccgatccgaggcggggagagcacccgggatggaaggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttcca

SEQ ID NO: 132895 - DNA, 4345 bp, Homo sapiens
  Payload ID: 5968
  Gene Symbol: FAM73B
  Gene Name: family with sequence similarity 73, member B
  Uniprot ID: Q7L4E1
  ENST ID: ENST00000439290
  CDS Start-End: 182-1153
gaaggagacgctgcccttccgcagcgatggcatcccggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagacggagtctcactctgttgccaggctggagtgcagtggcgcgatctcggctcagtgcaacctccgcttcctgggttcaagagattctcctgcctcagcctcccaagtagctgggattacagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggtgggtcactgccctgctctcagacccacacttgctcacatcagcccgtgtggttgcctggctccgtcccctctgtccctagcactggcaccagggctgggcccccaccccctagatccgcggctgccaggcctgggagaccagagtctgccctggagaagcctccagggtgccccgttgctgcctggtgccccagtttagaaccaacatggtgtgcgctttcttcctattgtgtggttttacttttgtgctggtatgaattcgattccattttaatgcatcctgttaaatcaagttaaaagaggggaaagcaaaaccaaaaggaaaaaaaggcacagagtgagagacaacccagcacaggacccccaggaaggcaagcagtaacgctccagcagccgggctgtgctgcctgggcccaggcttctgcgaggtggtttacaggcgggaaccattgctcccacaaccaccaaaggaggtgggagtgctgtgttgtgcccctttacagaagaggagaccgaggctcagagaagatccagcagtaagattagagtcaagattcaagtttaggtatgtctgagtccaaaatcagaggaggaagcagcagagcttaggcacctggccccatcttcctgcttggagtggggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacg

SEQ ID NO: 132896 - DNA, 3598 bp, Homo sapiens
  Payload ID: 5968
  Gene Symbol: FAM73B
  Gene Name: family with sequence similarity 73, member B
  Uniprot ID: Q7L4E1
  ENST ID: ENST00000445183
  CDS Start-End: 180-1229
aggagacgctgcccttccgcagcgatggcatcccggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcagagccccaaaggcttcctggagagctacgaggagatgctgagctatgccctgcggcccgagacctgggccacaacacggctggagctggagggccgaggggccaaggcagagggaggaatggcctcagctacacccgttgcacagcagagcgggaaagacgtgtcccccccacgtgtgctcatgccctggaccccagcttcagtctccccatctggaaagtggccccgaggctccggcagtgcccccatgcatgagcctcccgggggcaccctctgtaggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacg

SEQ ID NO: 132897 - DNA, 563 bp, Homo sapiens
  Payload ID: 5968
  Gene Symbol: FAM73B
  Gene Name: family with sequence similarity 73, member B
  ENST ID: ENST00000450073
  CDS Start-End: 265-563
agcggcgccagagggtacctgggctggagcgcagtggccccatcttggctcactgccacctccacctcccaggttcaagccggttctcctgcttcagcctcttgagtagctgggattacagctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagt

SEQ ID NO: 132898 - DNA, 574 bp, Homo sapiens
  Payload ID: 5968
  Gene Symbol: FAM73B
  Gene Name: family with sequence similarity 73, member B
  ENST ID: ENST00000414342
  CDS Start-End: 1-432
aagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgagggtccccggttcctgccctgccccaggccaaggcagagggaggaatggcctcagctacacccgttgcacagcagagcgggaaagacgtgtcccccccacgtgtgctcatgccctggaccccagcttcagtctccccatctggaaagtggccccgaggctccggcagtgcccccatgcatgagcctcccgggggcaccctctgtaggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctg

SEQ ID NO: 132899 - DNA, 1050 bp, Homo sapiens
  Payload ID: 5969
  Gene Symbol: FAM76A
  Gene Name: family with sequence similarity 76, member A
  Uniprot ID: Q8TAV0
  ENST ID: ENST00000010299
  CDS Start-End: 25-1050
cggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagaggctagagtgcaatggcacgatctcggctcactgcaacctccacctcccaggttcaagcgattctcctgcctcatcctcccgagtagctgggattacaggcattaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatga

SEQ ID NO: 132900 - DNA, 992 bp, Homo sapiens
  Payload ID: 5969
  Gene Symbol: FAM76A
  Gene Name: family with sequence similarity 76, member A
  Uniprot ID: Q8TAV0
  ENST ID: ENST00000234549
  CDS Start-End: 54-992
agataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagaggctagagtgcaatggcacgatctcggctcactgcaacctccacctcccaggttcaagcgattctcctgcctcatcctcccgagtagctgggattacaggcattaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatga

SEQ ID NO: 132901 - DNA, 2273 bp, Homo sapiens
  Payload ID: 5969
  Gene Symbol: FAM76A
  Gene Name: family with sequence similarity 76, member A
  Uniprot ID: Q8TAV0
  ENST ID: ENST00000373949
  CDS Start-End: 54-890
agataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatgacagacctcaaggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctttaaaaaataaaatcctttatttgcttatatcagttgtcatactgggctgctgtcagagaatgtttttttacatgaatgaacagattaaaaatggaataatatggtcgggtgcggtggctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctc

SEQ ID NO: 132902 - DNA, 3567 bp, Homo sapiens
  Payload ID: 5969
  Gene Symbol: FAM76A
  Gene Name: family with sequence similarity 76, member A
  Uniprot ID: Q8TAV0
  ENST ID: ENST00000373954
  CDS Start-End: 103-1026
gccgcagccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatgacagacctcaaggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctttaaaaaataaaatcctttatttgcttatatcagttgtcatactgggctgctgtcagagaatgtttttttacatgaatgaacagattaaaaatggaataatatggtcgggtgcggtggctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctcaaaaaaaaaaaaaaaaggaataatatttgaactacagagcatttttggggtcagcatgagctgctctagtaaggactcttgagtctgggaaaagtggtatcactataccttctccccactcctcacccacccgagcccatacactccctgcttttcatggatatgtattgaaaacaggtgcttctcagaagcactttgcctcaaccagagttatgtatgccctgcctatcttcccttcttaaccctgtaggaatatggatttacttttccaggaaaggggatagatttacatttctaggcatactctcaggtcctctatgtgatgtttgtgaaaggaattagggtgtgtcatgtgtgccatgaaacaacaaaaccaactaccctagaatcatttatgcagggggtactagagttagaaataataatgagggcagataacatttgtacctcagtctaccaaaaaattatagtactaaatttaacttctaggcgtttcctggaagcagatgctctataatttgtgatagcattctcataaatggagtcctacacataattggacagagatgtggaaatggtggtttccttctgataagggatacagtggaccatgtcgcttatatatcaccctactaggggatataattttcccttctaagcaagggaaatggcagtgctaaatagttttgtaaagtttttgaatgagaagcttttaggtaaagataaactgtcataatatttttcagatgcatttgcattgactatgggagaaaaattagggggaaatgacagtcatggtgtttttttttaattttaaggactgaaattctgttacatgatgtatgacaatataaaaacatacttagttttatactaaatctttttttaaggtcttggcatttaatataaagcaaattcacacgttttctaactttccataagttccaaaaagggaaagaagaaacctcagtcttgaaattttgatttttaaaaatcatgacactgttttaccatgaaattgagtagctaacttttggtaacaccttttgtttctttgtatgtttgtaataatggacattttaaaacacaggaatgttttggtttgtacagactttgacaaatgtgtgttaataaaaattcatattgactcaagtgtaa

SEQ ID NO: 132903 - DNA, 504 bp, Homo sapiens
  Payload ID: 5969
  Gene Symbol: FAM76A
  Gene Name: family with sequence similarity 76, member A
  ENST ID: ENST00000446647
  CDS Start-End: 1-375
cagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcagagatgggctctcgctatattgcctgggctagtcttgaactcctggcttcaagcaatcctcccacctcaacctcacaaagtgctaggattacaggcgtgagccaccatgcccagcctgtagatactttgtattgtttcactcttggatgtgttctgatcttttcccctcaaaaacagtagaattattaagtatgttctttgatttttgaataaaccagatgtgattcca

SEQ ID NO: 132904 - DNA, 1661 bp, Homo sapiens
  Payload ID: 5969
  Gene Symbol: FAM76A
  Gene Name: family with sequence similarity 76, member A
  Uniprot ID: Q8TAV0
  ENST ID: ENST00000419687
  CDS Start-End: 86-769
gcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatgacagacctcaaggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaa

SEQ ID NO: 132905 - DNA, 1027 bp, Homo sapiens
  Payload ID: 5969
  Gene Symbol: FAM76A
  Gene Name: family with sequence similarity 76, member A
  ENST ID: ENST00000530324
  CDS Start-End: 54-920
agataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggtgactgactctgcttattttatgtgctaaaattgtgtacctacctggtatacctagctgattgtattttaagtgatcatctcttagatttcttttttttctcaaagtattaacaaatcatgttaatccccctttta

SEQ ID NO: 132906 - DNA, 3952 bp, Homo sapiens
  Payload ID: 5970
  Gene Symbol: FAM76B
  Gene Name: family with sequence similarity 76, member B
  Uniprot ID: Q5HYJ3
  ENST ID: ENST00000358780
  CDS Start-End: 314-1333
gaaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagatagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgttttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagtaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagt

SEQ ID NO: 132907 - DNA, 3823 bp, Homo sapiens
  Payload ID: 5970
  Gene Symbol: FAM76B
  Gene Name: family with sequence similarity 76, member B
  Uniprot ID: Q5HYJ3
  ENST ID: ENST00000398187
  CDS Start-End: 138-839
ggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgttttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagtaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggc

SEQ ID NO: 132908 - DNA, 754 bp, Homo sapiens
  Payload ID: 5970
  Gene Symbol: FAM76B
  Gene Name: family with sequence similarity 76, member B
  ENST ID: ENST00000537749
  CDS Start-End: 614-754
atcaaagaaaatcaaggtatgtttttatagtttatgttgaatatgcttgttctcattttttcaaagttgaaaactcacagtatatattccttatatgatttgtacctatatgtgatgaaaagttaacattttctaaataaatgatatggtcattaaggtaactaggatattagtagaaggacgtttcctcaaattcttgattcatgagacttctctacatatgtacctttattttcgttctttaaaaccttttttatgtgtagtttttgtattatctaacagactatgcaaatcacaaatctatttctcacgatcttagagtaatagttacatgactagaaataaatactagttgaatgcatagaaatatggtataaaagttattgcatgtgacagggcaacaaacttgacagaaaacaaattttttacctgagttttcttaattccagaaatatgtctacaacactgggtatatgctatgccgcaaatatttaatgtttttaaaagtctcaaaatgtgtatgtttttcagcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaag

SEQ ID NO: 132909 - DNA, 2546 bp, Homo sapiens
  Payload ID: 5970
  Gene Symbol: FAM76B
  Gene Name: family with sequence similarity 76, member B
  ENST ID: ENST00000536839
  CDS Start-End: 84-1100
gcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagatagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgttttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagtaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtga

SEQ ID NO: 132910 - DNA, 730 bp, Homo sapiens
  Payload ID: 5970
  Gene Symbol: FAM76B
  Gene Name: family with sequence similarity 76, member B
  ENST ID: ENST00000540054
  CDS Start-End: 457-730
gacgtcacaaggtagcgcgtaacggggcccgctggggcagacaacgccggggttacaggccggctctgcggggattctacggagggtcgggcctcctccagtaagaagcgtgggcgagtagtggtgtcgccagtggcaactgaagggagtaatggagataaaacaaaagcgaaggcgaagttaaagcactccacgagttccctcggattaaacgccggagagagcgtgaatttgcctcggggacgcctctccaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaa

SEQ ID NO: 132911 - DNA, 585 bp, Homo sapiens
  Payload ID: 5970
  Gene Symbol: FAM76B
  Gene Name: family with sequence similarity 76, member B
  ENST ID: ENST00000538316
  CDS Start-End: 291-440
acagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaaagcgaagcgactggtttgggaacagaatgctctgatttggagctcctcccatcccattaaagcctggatgctgtctgtgagcaacggaatgtcggattgcacatcctattgtaaaatgtacttactgcagatcagaatttcaacaagagagcaaaactaacacaatttgtaagaagtgtgctcaaaatgtgaagcaatttgggac

SEQ ID NO: 132912 - DNA, 1379 bp, Homo sapiens
  Payload ID: 5970
  Gene Symbol: FAM76B
  Gene Name: family with sequence similarity 76, member B
  Uniprot ID: Q5HYJ3
  ENST ID: ENST00000543641
  CDS Start-End: 313-1014
aaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaaggatccaatatttcacaataaaaaacttgtcaaag

SEQ ID NO: 132913 - DNA, 610 bp, Homo sapiens
  Payload ID: 5970
  Gene Symbol: FAM76B
  Gene Name: family with sequence similarity 76, member B
  ENST ID: ENST00000542135
  CDS Start-End: 337-610
atcagggatgggaaagggaggccgagaaggaagcggatccacggccgcacagctaaacagcaaccccctacccgcttcgtctccctccgccgctatcggggcctaagcgggagcggctggcacggcgtcactgggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaa

SEQ ID NO: 132914 - DNA, 3659 bp, Homo sapiens
  Payload ID: 5971
  Gene Symbol: FAM78A
  Gene Name: family with sequence similarity 78, member A
  ENST ID: ENST00000372269
  CDS Start-End: 71-913
cttccaagcactggaaacaaacattggagaccaagtgaggcgtcactcaacagccgtagtaatcagggaaatgacaagttacatactgatatcctttgttttgctgattggagttgggtgcattgaaaaagatcagtcgtgcccagtgtttgggggaaggaagcgtcttcacctgttgtttgtgggaggacagttgaggcaggtgaggatgctgagagggtctccagaagcttccactgactgctgttggctgcaccaggcaacagggtctggctctgtcacccaggctggagtgcaatggtatgatctcggctcactgcaacctctgcctcccaggttcaagcgattctcctgcctcagcctcccgagtagctgggattacaggtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaatatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcaacaggtgaggacagacgtctggaagcccatccctgggacctgccctccctcggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtctgctccttcagcctccttgctcatgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtacaatgaacctttttttttttacaaaaaacaaaaagcaaatattcataaagagaaataaaatgtaattttaaagtagg

SEQ ID NO: 132915 - DNA, 3966 bp, Homo sapiens
  Payload ID: 5971
  Gene Symbol: FAM78A
  Gene Name: family with sequence similarity 78, member A
  Uniprot ID: Q5JUQ0
  ENST ID: ENST00000372271
  CDS Start-End: 369-1220
cttccttatttatgagtctgccggcgctcgcctgcttcctccgaagacttcagggagagtctgcgagctgccgtccccgcgtgtgaggcacagaagggctggatgtcagaaccgcataattattcattaaactacaaactttttttaacccaaagaatatcggtgatttttgtccactgcgaggagaagaagagagagcccagggctcatgaaatgcagcagaatccttatttataaacaggccgcggtagtgatatatgcaaccccagtctactcagtgagttttctatcctatggatatcggtcttgagagttgagattggagagcagcgccgtctgtactgggtcctgcagcctctgtcctttcaatgcctggttttttctgtgactgctggccttccctggagatcagagcgctcctgtatgccatgggctgtattcagagcatcggaggcaaagccagagtcttccgggaagggatcacggtgattgatgtgaaagcctccatcgaccccgtccccactagcatcgatgagtcctccagcgtggtgctccgctaccggacaccccacttccgggcctcggcccaggtggtcatgccgcccatccccaagaaggagacttgggtagttggctggatccaggcgtgcagccacatggagttctacaaccagtacggcgagcagggcatgtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaatatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcaacaggtgaggacagacgtctggaagcccatccctgggacctgccctccctcggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtctgctccttcagcctccttgctcatgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtacaatgaacctttttttttttacaaaaaacaaaaagcaaatattcataaagagaaataaaatgtaattttaaagtagg

SEQ ID NO: 132916 - DNA, 792 bp, Homo sapiens
  Payload ID: 5971
  Gene Symbol: FAM78A
  Gene Name: family with sequence similarity 78, member A
  ENST ID: ENST00000464831
  CDS Start-End: 1-759
ggccaagggattgctgcagccctcatccaccttccaagcactggaaacaaacattggagaccaaggtctccagaagcttccactgactgctgttggctgcaccaggcaacagggtctggctctgtcacccaggctggagtgcaatggtatgatctcggctcactgcaacctctgcctcccaggttcaagcgattctcctgcctcagcctcccgagtagctgggattacaggtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaatatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaa

SEQ ID NO: 132917 - DNA, 1597 bp, Homo sapiens
  Payload ID: 5972
  Gene Symbol: FAM78B
  Gene Name: family with sequence similarity 78, member B
  Uniprot ID: Q5VT40
  ENST ID: ENST00000338353
  CDS Start-End: 591-1376
gtcctgtgctgctccagccgttggggctctccaccccgggccacagcctcctggcgccccccgggccgaggcagccgggccgaggagtgtcggtgtggtccggctacggggcggggccggcggcggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccctgccggagcgagggggcgggcgtgggcggacgtcggggcagcggggaccccgcgcggctgcaagaggagggggcttccccaaggatgcccggcggctccccgctcctaggtgcgagctgagtctgaccgggagcgagcggcgcgtcgccatgccggcgtgacgggcgcccccggctgcccgcgcgggcccccgcgctgccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttg

SEQ ID NO: 132918 - DNA, 1475 bp, Homo sapiens
  Payload ID: 5972
  Gene Symbol: FAM78B
  Gene Name: family with sequence similarity 78, member B
  Uniprot ID: Q5VT40
  ENST ID: ENST00000354422
  CDS Start-End: 468-1253
cggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccctgccggagcgagggggcgggcgtgggcggacgtcggggcagcggggaccccgcgcggctgcaagaggagggggcttccccaaggatgcccggcggctccccgctcctaggtgcgagctgagtctgaccgggagcgagcggcgcgtcgccatgccggcgtgacgggcgcccccggctgcccgcgcgggcccccgcgctgccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttga

SEQ ID NO: 132919 - DNA, 2300 bp, Homo sapiens
  Payload ID: 5972
  Gene Symbol: FAM78B
  Gene Name: family with sequence similarity 78, member B
  Uniprot ID: Q5VT40
  ENST ID: ENST00000456900
  CDS Start-End: 134-919
cgctcctaggtgcgagctgagtctgaccgggagcgagcggcgcgtcgccatgccggcgtgacgggcgcccccggctgcccgcgcgggcccccgcgctgccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttgacagacttgctgtgattaccatgcaagtagccatattttggagctgaccaggatgattcttttatctgaactattgaccatttctttcctgtgagatgcaggggatggaaacgaaattaaacagtgcctgtggcaaatgctgcttcccagccaattagaagtaggagtgaaaacatccacaccaggtctcctagtaggacaaggaaagcccagcaagcacaaccacatggcagagactgagaaggaggaagtgagcaatggctggcggctccagaagctgaatccctggacagctgatttcccattaaaatgtgtgccatcctgcctacctcctcgccttcctcccgtcccgtgaccagtccctcctacccaccctccacgagccatgtggcacttgccctgggctgattgggctgcctgcttggcccatggggagctgtgttaaagtgagagttgtgcctgctgtatctttttgtgtgtagaaagatggggttcattcagatcccaagtcctttccccaaccctcaaagtgaagcctcctagggatgaagagctggtcagcctggactttaaatacctaatgtggcccagccttggttcccaaaccctgccttccctccctatgcttttgggtgggaaacgggggatttgtatctcccttcctcctccttctccatgtgggtggcctctctaggtttctctgtgttctctgatccttggagagccagagccaaggcagtcatcttgttcccccttccacggccaggctgggtgccttcaggtgaccaggggcagagtgtaagtcaccaggttcaatggggtgaggggagaaccaccttaagagggaaaaaatggtgtgcattggtttatttattggtttatttattggcttgcttactgatgtatttatttgtatttattatacaacacaaaatccatttccattttttaagcatcagccccagaatttgtcttcctgggcccatagagcacagcgaattatttctctttgaagcttcagaatagagagggaaatttttctccttacgcccaaacacctccacctcagccacattttcaaccagacatgggattagaaatcaccagctaacaaggctgtaaagtcacacaaatcagcagaggcttgactgtctagatag

SEQ ID NO: 132920 - DNA, 2264 bp, Homo sapiens
  Payload ID: 5972
  Gene Symbol: FAM78B
  Gene Name: family with sequence similarity 78, member B
  ENST ID: ENST00000441649
  CDS Start-End: 1-772
aagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttgacagacttgctgtgattaccatgcaagtagccatattttggagctgaccaggatgattcttttatctgaactattgaccatttctttcctgtgagatgcaggggatggaaacgaaattaaacagtgcctgtggcaaatgctgcttcccagccaattagaagtaggagtgaaaacatccacaccaggtggtcgtaagacagactcctgctgtctgactggagggtgctggggaaatgggtggtgaaagaatgggtgatggggagaggaaagaataaggttttatgacacattaatacttctgcatttattagttgataatcagatcaacacactcaatggaatgaatgcttagaaaactagacaaatactgatatttgctcctttctgagggagaaagcctccttggaactgtccaaggtgctgatgtgaactaacggaaacacttcattagttccgtctacccacctctttccaaaaagattgcttattcagagtatttttaatcacagtctcctagtaggacaaggaaagcccagcaagcacaaccacatggcagagactgagaaggaggaagtgagcaatggctggcggctccagaagctgaatccctggacagctgatttcccattaaaatgtgtgccatcctgcctacctcctcgccttcctcccgtcccgtgaccagtccctcctacccaccctccacgagccatgtggcacttgccctgggctgattgggctgcctgcttggcccatggggagctgtgttaaagtgagagttgtgcctgctgtatctttttgtgtgtagaaagatggggttcattcagatcccaagtcctttccccaaccctcaaagtgaagcctcctagggatgaagagctggtcagcctggactttaaatacctaatgtggcccagccttggttcccaaaccctgccttccctccctatgcttttgggtgggaaacgggggatttgtatctcccttcctcctccttctccatgtgggtggcctctctaggtttctctgtgttctctgatccttggagagccagagccaaggcagtcatcttgttcccccttccacggccaggctgggtgccttcaggtgaccaggggcagagtgtaagtcaccaggttcaatggggtgaggggagaaccaccttaagagggaaaaaatggtgtgcattggtttatttattggtttatttattggcttgcttactgatgtatttatttgtatttattatacaacacaaaatccatttccatttt

SEQ ID NO: 132921 - DNA, 4410 bp, Homo sapiens
  Payload ID: 5972
  Gene Symbol: FAM78B
  Gene Name: family with sequence similarity 78, member B
  ENST ID: ENST00000435676
  CDS Start-End: 1-763
ctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttgacagacttgctgtgattaccatgcaagtagccatattttggagctgaccaggatgattcttttatctgaactattgaccatttctttcctgtgagatgcaggggatggaaacgaaattaaacagtgcctgtggcaaatgctgcttcccagccaattagaagtaggagtgaaaacatccacaccaggtggtctcctagtaggacaaggaaagcccagcaagcacaaccacatggcagagactgagaaggaggaagtgagcaatggctggcggctccagaagctgaatccctggacagctgatttcccattaaaatgtgtgccatcctgcctacctcctcgccttcctcccgtcccgtgaccagtccctcctacccaccctccacgagccatgtggcacttgccctgggctgattgggctgcctgcttggcccatggggagctgtgttaaagtgagagttgtgcctgctgtatctttttgtgtgtagaaagatggggttcattcagatcccaagtcctttccccaaccctcaaagtgaagcctcctagggatgaagagctggtcagcctggactttaaatacctaatgtggcccagccttggttcccaaaccctgccttccctccctatgcttttgggtgggaaacgggggatttgtatctcccttcctcctccttctccatgtgggtggcctctctaggtttctctgtgttctctgatccttggagagccagagccaaggcagtcatcttgttcccccttccacggccaggctgggtgccttcaggtgaccaggggcagagtgtaagtcaccaggttcaatggggtgaggggagaaccaccttaagagggaaaaaatggtgtgcattggtttatttattggtttatttattggcttgcttactgatgtatttatttgtatttattatacaacacaaaatccatttccattttttaagcatcagccccagaatttgtcttcctgggcccatagagcacagcgaattatttctctttgaagcttcagaatagagagggaaatttttctccttacgcccaaacacctccacctcagccacattttcaaccagacatgggattagaaatcaccagctaacaaggctgtaaagtcacacaaatcagcagaggcttgactgtctagatagccctcagaatccggcctccaccccaaccaccttgcaccagtcttctcattctcctttactcaggtggggattgaccagccatcttcagcctaacagtgcagaacaaaacttctcattctgctctgatgtagtattctaacatcagatgcacgttagaatcatctgaggagcttaaaaaatatccatgcctggtcccctgcccaaaccaattatagcatcgaagggtagatcctgggcatcggagttttttaagttacccagatgactctaatgtgaaaatagggttggaaagttctagtatcacctctcccttgcccctccccacccagattctttcatctctacttcccaagctttctctggagtcctcttcccgttcctccagccccttctcctctctgcaccttccccatcagctcagccaaccatagcagatccctggagagggggcaggtcccatgagtggtactctgaggctggttcctgcatccagcctgcgggctgctcccaaacaatttccagcttttctaggagcagaaacctactctctgcaggattctctgttcacctgcaccttctccaggttcccaaactccaaaagtttaaagggcactttggcgacatttctgtctccaagccccagtcttgatggtatggcccatgtaagtcttataacccaagccttggccatttctgcagagccacctgagttgaatgaggatctactgttaacagagaaaggggtcacagtgctcccccagcaagtcctttttccaacaaccaacctcctcagccatctaggatttgggtccacaatgcagcagctactgtgcattcaaatcctagatggctgagaagaggcatctcacccttcacatctacaagatctccactgctgggtatgagtaaatgtgtgtgtgagtgcgtgtacacgtacatgtgcacacactgtctacatacaaaccatctagatctatagagatgccaggcttcactttacatgtgattacattctacatgaaaacagttgagggcttttgttatctttcacttgatggagtttcactgtattatgttcatgatgggccccagtgaactccatatcaggtatatacatagaatgtataatatatacaaactgttagacacactacacacacacacacacacacacacacacacacacacaaagcctagggaaacctgtgatgtgggtaagttcattttgccatcccatctcctccatctaagtaatttcccggggcaagcattgtttcacacactcccctcagctgcccagccattccctctccagcgtcccataccaccaagccttctttccccatcagtccaaatgtccctgccctatgtcccatctctcagggtcctactctctgataggtgacagttcagtcagtgggtgctaaagagtcgagtgttacccttcccaggtgacatttacattttaataggggctacagataatgccttaatcagaaagagtggctgtagtggtgggaatttcaggcccagaagtgggccagtaagggagattcttttatatcaggagggcattttagagcccccgagtcatacctgtctgtaagcgcagcccttcataagtgcatgagcacaagcaagcacacttgcctacattataccctccataattttgagatacctcccttgcattggccctatctttaaaaatgaaaaaaaaaaacccaaaaaaaacaaaaacaaaacagggaactagctaaattaatttagatctcgctgggaaacgtagcctattttttcaccggctgccagccatctggcccaccccaccctgttcaatttcccttctgctctttatcttttcagctatgactgactatatcagttaatttacttgtacgtgtcctctctgctgtctccttaccctgctcccctacaccatgtatttccttcctttaccatttcctccttggaattgtgctgtgtttcgttgtcctggaggacagaagagcaggttaaggcatgagcatgtgtgtatcactttgaagaaagagaaaccaggtattctgctacagtttggagaaaaacccaatgaaggaagaaatgaaagctggctctgcagagtgccttaaaaatgactttaattaggaaattctgagttgtcagtcttcagatgttacataaactcaaacagatgttgcatttcacttctctgggattaaaaaaagttaaatacagtgtgtattcaacaacaacaacaaaa

SEQ ID NO: 132922 - DNA, 4677 bp, Homo sapiens
  Payload ID: 5973
  Gene Symbol: FAM8A1
  Gene Name: family with sequence similarity 8, member A1
  Uniprot ID: Q9UBU6
  ENST ID: ENST00000259963
  CDS Start-End: 56-1297
gggggagggaaacggagcagtgacaggtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcagagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaactgaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgca

SEQ ID NO: 132923 - DNA, 3465 bp, Homo sapiens
  Payload ID: 5974
  Gene Symbol: FAM81A
  Gene Name: family with sequence similarity 81, member A
  Uniprot ID: Q8TBF8
  ENST ID: ENST00000288228
  CDS Start-End: 188-1294
gcggcgcgggcccgcagccgggcgccctgctcagccagcgccagcggccgccgcacccagccgcgccggcgaggacatgggcagccgcggcgcgcccaccccccgcgccgatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattctgccttaaagaccctggagatgcgccagctctccggtttgggagatcttcgaggaagagtggcaagatgtgatgccagcatagctagactttctgcagagcacaaaacgacctatgaggggctccagcacttgaacaaagaacagcaggctgccaaacttatcttggaaacgaaaatcaaagatgcagagggacagatttctcagcttttgaacagagtggacttgtcaatatcagagcagagcaccaaactgaagatgtctcacagagacagtaaccaccagcttcagcttttggacactaaatttaaaggtacagttgaggaactcagtaaccagatattatctgcacggagttggttgcaacaggaacaagaacggatagaaaaagagcttttacagaaaattgatcagctttccttgattgttaaggaaaacagtggagccagtgaaagggatatggagaagaagctcagccagatgtcagccaggcttgacaaaatagaagagggtcaaaagaagacttttgatggtcagagaacaaggcaagaagaggagaagatgcacgggcgaatcaccaagctggagttacagatgaaccagaacatcaaggaaatgaaagcagaagttaatgctgggtttacagccgtctatgaaagcataggatccctcaggcaagttctcgaggccaagatgaagctggacagggaccagctacagaagcaaatccagctgatgcagaagccagagacccccatgtgaagggagctgggacaaggtcctaaaagacagttttgccagtggggctaggagccggatacctctgtagccaggccatcgctgcattcaggattgttccatccatggcgtgcatgtgccaagaaatgtgtttttatgggtctaaatgtttaccttgagtcttgaaaatactcttttgttaaaagtatgaaatacagtttttaccagtttatttcacttctctaaattcaatggaaatcccccgccctggattttgaaaggcttttatcttcttcattttacgaatggaaagacgacaatttttcttcaatgcttgatgcactaatgaagactgtttactattttgaaaaatgtcatggggatttttttttaattaagaaactaatgaatcatcacaggaatgtgttgctcctcaccctaaattaagagaatgtcccagtagattagacttcaacctttgagtccaatttggattttattatcgttgtctatgcacttcttatattggttatcttcttgtaaatcttctgtcttttgtaaggggaaaggatttaacatttagaataaaccccaccatttatgtaatggaaatagtttaaaaattgctaactgccatgtggattgcaaattaaatggaaacttatttagataacgtaaggctcaatatctgcgttgaccacctagatattacaggttttaatatttaaaactatttttgaattatccacaacctgtatagtgatagccatatatttaataatggaatggtggttaacagtctatttactgcacaattaattgttcactaatcaaatagaatgtggtaatttttcagactttatgatctgtttccaaaattggcacaaagtgctagggtttatatacacttatcgtaactgtatttttgtgccttggttttatcatgtcaatgcactgtactctgtaaaagttttgcagacaaaatagaaagtatgataatccgtcagaagtatgatgtaaaactggaatcctctgtattttttaaatgttctaaaaattttatcgctgttaaggtattaatcattcagtattactaatggaatagaaattcatacttttgtatggacaacaattcaaattgatattgcatttatagcactgtaagaaactttcatcttgagcaactttgtagatgatgggtgttttattttcaatcgccatatttgatcagtcattgaaaattggccccagtgctgtttgttcatctctgtatgtaaaaactgacagtgagacacaacgttctgaactgtgagggtgtcccaggaaaaagaaaaacaggaatactttaacaattaaaaagaaaaaaatgttttttgtttgccaaggactcaggaaaataaaaagcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacaccccctccagcatctctgtcttgtggggtctttgaggagaaggaatcagaacatcgacacctgggaagagggaggcggggaacaccagctggactctggccaaggagtgatgtaagcaggtgacacttggctgtcagctgagcttctcaggtgcttctgacattgccagccccttgagatgagccaccgcaggtgtgctcaccttggctacatgttgaaatcatccagaggagttgggaaatctactgatgccccgctgtgcctcccagaccgattaagtcagaacctctgggaggtgggtcgcaggcatcagtgcgtgcccgaggcctccgcgtgtttgggtgtgcagccgaggtggtgagctgtcgagccacagtgcagttctcttctcaccaaagctcaaatgagaatcagcttccatgttctttcctttaccagaaatttgcaataaaaagaaaaataaaattttca

SEQ ID NO: 132924 - DNA, 513 bp, Homo sapiens
  Payload ID: 5974
  Gene Symbol: FAM81A
  Gene Name: family with sequence similarity 81, member A
  ENST ID: ENST00000560474
  CDS Start-End: 74-513
agccgcgccggcgaggacatgggcagccgcggcgcgcccaccccccgcgccgatgtgaattattaaaaagaaaatggcccaacggagcactgtatttccttctcgtgtcaccaaggaaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattctgccttaaagaccctggagatgcgccagctctccggtttgggagatcttcgaggaagagtggcaag

SEQ ID NO: 132925 - DNA, 528 bp, Homo sapiens
  Payload ID: 5974
  Gene Symbol: FAM81A
  Gene Name: family with sequence similarity 81, member A
  ENST ID: ENST00000557914
  CDS Start-End: 325-528
agccagcgccagcggccgccgcacccagccgcgccggcgaggacatgggcagccgcggcgcgcccaccccccgcgccgctgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaa

SEQ ID NO: 132926 - DNA, 656 bp, Homo sapiens
  Payload ID: 5974
  Gene Symbol: FAM81A
  Gene Name: family with sequence similarity 81, member A
  ENST ID: ENST00000560394
  CDS Start-End: 258-656
agtttccaaagatctctggatcctgtagtcctcctcccgcgccagccaccgaagaacgctgcggacccagctcgctcctggtagcaagacccgaactatccagaacatttctgccttcaactccagcaaggatctgaaggtccaggaccttaggaaagctgcctgcagagaggtggagagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattctgccttaaagaccctggagatgcgccagctctccggtttgggagatcttcga

SEQ ID NO: 132927 - DNA, 567 bp, Homo sapiens
  Payload ID: 5974
  Gene Symbol: FAM81A
  Gene Name: family with sequence similarity 81, member A
  ENST ID: ENST00000560087
  CDS Start-End: 189-567
gctgaagttgggcacagagcgcaactggcgttgcattttcgcgggggctgcatgctagcgaaccaaccgacgcccggagggactgtttgggggagctggggtggtgcacggattgccaggggtaaaggcgagtcagccgacccactactcagagtgagtgaccttggatgtgaattattaaaaagaaaatggcccaacggagcactgtatttccttctcgtgtcaccaaggaaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattctgcct

SEQ ID NO: 132928 - DNA, 572 bp, Homo sapiens
  Payload ID: 5974
  Gene Symbol: FAM81A
  Gene Name: family with sequence similarity 81, member A
  ENST ID: ENST00000559628
  CDS Start-End: 370-572
gctcagccagcgccagcggccgccgcacccagccgcgccggcgaggacatgggcagccgcggcgcgcccaccccccgcgccggtaaaatcaaaacccaatcgtggcaggcagcagcaaattaactgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaa

SEQ ID NO: 132929 - DNA, 581 bp, Homo sapiens
  Payload ID: 5974
  Gene Symbol: FAM81A
  Gene Name: family with sequence similarity 81, member A
  ENST ID: ENST00000561361
  CDS Start-End: 235-581
agatttccgggtggcgagctgctgagcttactgggaacttcagtcttcctccctgaaggtgtctgcgtttgctgactggttgtcaccccctgccccacttcagaacgcgtttgtgaagaagacattctctctggatgaagcaactacagaagtgcagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattc

SEQ ID NO: 132930 - DNA, 573 bp, Homo sapiens
  Payload ID: 5974
  Gene Symbol: FAM81A
  Gene Name: family with sequence similarity 81, member A
  ENST ID: ENST00000560123
  CDS Start-End: 399-573
atcagactcaaatgcctgctcctcaagtgcttttcctgatggcccagttcaaactgatcctgccttctgcccagtggcactgaccagcccctccattcttgcacggtggcttgctagtgttatttccctgcataatgggagttcctgcagcgcaggggctgtgtcttgttcagcactgtagaggctcaatgaatatttgttgactggactaaattatttgatgaaatcattaagcaagtgcacagaataaccgtggagctgtctgctagcacgtggtgtgcgatggtggatgtgagacccatgccttacccgaagagtcagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattg

SEQ ID NO: 132931 - DNA, 557 bp, Homo sapiens
  Payload ID: 5974
  Gene Symbol: FAM81A
  Gene Name: family with sequence similarity 81, member A
  ENST ID: ENST00000560074
  CDS Start-End: 213-557
gcattttcgcgggggctgcatgctagcgaaccaaccgacgcccggagggactgtttgggggagctggggtggtgcacggattgccaggggtaaaggcgagtcagccgacccactactcagagtgagtgaccttggatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaat

SEQ ID NO: 132932 - DNA, 573 bp, Homo sapiens
  Payload ID: 5974
  Gene Symbol: FAM81A
  Gene Name: family with sequence similarity 81, member A
  ENST ID: ENST00000558348
  CDS Start-End: 248-573
agggcgagacggcggcgacttagcaggcggggcgcatgctgcggagggcaagagtccactcgtactcgccggtcgccgccggcccagatccagaacatttctgccttcaactccagcaaggatctgaaggtccaggaccttaggaaagctgcctgcagagaggtggagagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaa

SEQ ID NO: 132933 - DNA, 1560 bp, Homo sapiens
  Payload ID: 5975
  Gene Symbol: FAM81B
  Gene Name: family with sequence similarity 81, member B
  Uniprot ID: Q96LP2
  ENST ID: ENST00000283357
  CDS Start-End: 47-1405
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagatagaaactgccagttctgagcaaacctcgaatttaaagatggtccagggggattatcgccacgaaatgaaccttttggaattcaaatttcattcactttcaagtaatctgtacgaagaagttgagaataataaaaaatggacagaaaaccaatttctcaaatatagaaaagaccacctgggccatataaatgaatgtctgaaggtcctacaggagaaactggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagctt

SEQ ID NO: 132934 - DNA, 556 bp, Homo sapiens
  Payload ID: 5975
  Gene Symbol: FAM81B
  Gene Name: family with sequence similarity 81, member B
  ENST ID: ENST00000512365
  CDS Start-End: 1-384
attcaagaattcgtgcccgccctggaaactctttccaagaacttggacatgaaggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttcggatgtcttgaattta

SEQ ID NO: 132935 - DNA, 596 bp, Homo sapiens
  Payload ID: 5975
  Gene Symbol: FAM81B
  Gene Name: family with sequence similarity 81, member B
  ENST ID: ENST00000513110
  CDS Start-End: 1-162
gtgatgcagctcttaggaaagatagaaactgccagttctgagcaaacctcgaatttaaagatggtccagggggattatcgccacgaaatgaaccttttggaattcaagaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttcgga

SEQ ID NO: 132936 - DNA, 1527 bp, Homo sapiens
  Payload ID: 5975
  Gene Symbol: FAM81B
  Gene Name: family with sequence similarity 81, member B
  ENST ID: ENST00000507832
  CDS Start-End: 1-547
aactgcgactgcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccaggacctccctccttgcccgcttatacctgagagaaactggctgaagtgcgacaggctgaggaaggagagagatttgatactgcaagcctgaatagaggatgctatctaccagccaccaaacacactcactgatcctctgcagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagatagaaactgccagttctgagcaaacctcgaatttaaagatggtccagggggattatcgccacgaaatgaaccttttggaattcaaatttcattcactttcaagtaatctgtacgaagaagttgagaataataaaaaatggacagaaaaccaatttctcaaatatagaaaagaccacctgggccatataaatgaatgtctgaaggtcctacaggagaaactggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcagatcatggaatttttactaattcatggaattgtcagacttggaaaatccttggacatacccaagacgtgacttgtgggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatg

SEQ ID NO: 132937 - DNA, 567 bp, Homo sapiens
  Payload ID: 5975
  Gene Symbol: FAM81B
  Gene Name: family with sequence similarity 81, member B
  ENST ID: ENST00000503099
  CDS Start-End: 1-124
acctgatggcccccttcctggctcagacaataaccaagaaaagaaagtaagattatctccagccaaaatgtcaaccaagaattctacagatctagttgaatatgttgacaaagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaag

SEQ ID NO: 132938 - DNA, 510 bp, Homo sapiens
  Payload ID: 5975
  Gene Symbol: FAM81B
  Gene Name: family with sequence similarity 81, member B
  ENST ID: ENST00000513529
  CDS Start-End: 1-263
gtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaaggtgat

SEQ ID NO: 132939 - DNA, 740 bp, Homo sapiens
  Payload ID: 5975
  Gene Symbol: FAM81B
  Gene Name: family with sequence similarity 81, member B
  ENST ID: ENST00000503361
  CDS Start-End: 1-381
gcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagatagaaactgccagttctgagcaaacctcgaatttaaagatggtccagggggattatcgccacgaaatgaaccttttggaattcaaatttcattcactttcaagtaatctgtacgaagaagttgagaataataaaaaatggacagaaaaccaatttctcaaatatagaaaagaccacctgggccatataaatgaatgtctgaaggtcctacagg

SEQ ID NO: 132940 - DNA, 1858 bp, Homo sapiens
  Payload ID: 5976
  Gene Symbol: FAM83A
  Gene Name: family with sequence similarity 83, member A
  Uniprot ID: Q86UY5
  ENST ID: ENST00000276699
  CDS Start-End: 177-1280
attgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccgttcctgaaagtaaacaaaacaaaacaaaaacaaaaaaacaaacaacactttggttcctgatggctttctgaacccagccctgaccttgttgtttcacagctgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaa

SEQ ID NO: 132941 - DNA, 1604 bp, Homo sapiens
  Payload ID: 5976
  Gene Symbol: FAM83A
  Gene Name: family with sequence similarity 83, member A
  Uniprot ID: Q86UY5
  ENST ID: ENST00000522648
  CDS Start-End: 177-1061
attgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaactgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaagcca

SEQ ID NO: 132942 - DNA, 5393 bp, Homo sapiens
  Payload ID: 5976
  Gene Symbol: FAM83A
  Gene Name: family with sequence similarity 83, member A
  Uniprot ID: Q86UY5
  ENST ID: ENST00000518448
  CDS Start-End: 2015-3319
gatgacttggagaacagtcacttcctctttctgggctacagttttctcatcagtaactgaagagcttgcagtaccttcaacattccttcaggtgaggacttctctttgatcactgctatggtttgaatgtgtctcctaaagttcatgtgttggaagcttgatccccagtgcaaaagtgttgggaggtggggcctaatgagaagtaattaggccatgagtattctgccctcatgtattcatgagattaatgtcattatcatgggagcgggtttgttaaaatgagttcggccccttccttctctctctttcttctgccatacagtatgggatgcacagtgcagaaggtcttaccagatactggcaccatgcttttggacttctcagcccccagaaccatgagccaaataaatttctgttcattataaatcacccagtctgtggcatcctgttagagcagcataaatggactaagataatccctataaagagtggcaacagaacagttcccagctcactggcagaatcctatgatcaactagtaatgtctgccagggaaggaggatgagtggcactaacatgtacggtgtgtttgctcactgttctacaggattcaactagaatctctgggtctgtgtgaagaccaagagctgggaacagaagcagggctctagagggaaaagtttctttcggattccttttttttgttttgttttaaagagctgctctgtgagaagacaaggagaaaatggtccctacaggatactcacctctgtctcagggagacactcaagcatttattcaaccaagaaagagaattagttccaggtgaaaggagaaccccagaatacccacctacttttaaaattctcccctatgcatattcaggaaccaatcagaggatctgtaatgcgctgtgagtagaaagggaaggggaatgggaaagaaaaaagtgaagcttggaatggtggaaagtacatgggctctgccatttaccagctaagtgatcttgggcaagtaacttgacctttctgagcctcggtttcctctttggtgaaatgaggactaataatccatttctccctcagtacagacagccagcatgcagtgagcactcagcgatggccaagtatgggagaagccatgctggaatgaacatgtgggaccattttgtgcagtttctcagcgccaacactgactggtcccctgggctcgtgggccgccggcagcctcggctcgttctccagacagtgttccaagaagccacttccagcgaggaagcgttggcctgagaactggaacctctgcggtctctgcaaacacgacaatgacaaacacttgagagggcatgggagaaaggagctccttcatagggcagggaggggtgggcacttgggtgtgaccaaggagaggaggcgcgcctggtcaacagctctccctggcccgtgtccagctccctcctcacacagagaggggggcgcatctcagggatggcatctttcccccccacagggaaattcttatctttgaaacagcatgggaatcgaggcacccaggaggggagcagaggcaggcaggcctccttcaggcccatcctccagctgggctggtggtgccagggaggctccctgcttggtaacaaaggcctgagggagagttgcgaaacccagcaggaaagccggctcaccttcgcctccccctgcggctgggaggagaggaaatatcccatggctgactgtgccaaggaggtgtctgagccagccctcccggcccgagggcagggcaggtggccctgagagataagccaatcccgcagctgcagatgaggagttctgagaagcattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaagtgtgtccgcgtcttcagggccctgtagccccgcggccccacacccgcctccaccgccccggttccagccccaccaaggcccttggggagccccgagtccccaggcccacctctccccgcggccccacgacggcccgcccgccgctgtctacagcaacctgggggcctacaggcccacgcggctgcagctggagcagctgggcctggtgccgaggctgactccaacctggaggcccttcctgcaggcctcccctcacttctgaaggtcccatcccctgctgccctccgcaggcccagggctgggcactccctgagacccaaagacccacctcaacgacgagtggcgttgagccacttccctttgaaaagacactcaaaatcactgccatggttcaatgttcccaggccccaggccatccacttgccggcccccaccagttcttgggttccccgctctagtttgacctgtgcagcacattccagaaggttccagggaggttgtggggcagctagaggacaaaatcatgaaaacagagtccctgtcttccagagatcatccggggctttaatattaatggcccccaaaactccgtaagaagcaggaaatgcagcccaagttttacaaatgggtaaacagaggcactgagagatagatggtagtttggtacttctggttcccagtgcccaggaatggtccactcccaagaaattcaggaaagaaagactgaggagaaggtgtgggaacattctggatgtttcgggagagttggggaaactcctcctcttaggaaaggctaatactagggtatccttgggcccaatgaattaggggtgaggccccagaacccgttatctatgagttgtatgggggagccatctgaagctgtagccaccagggatgcagctagctgaggagtttggggtgttgggttggacaaggcaggttagtagactcagattcttgcttcaaagagccttgggctggcctggaggtccctggagtctagactggacctaggagcttgagttgtcaggggccaggactggccccactgcagtgcccaggccagtcttgagcagcagggagggctcagctgtccccagatccaggtgcctctgaccagcctggtcacctcctgaggaataaatgctgaacctcacaagccccatcattcatttcttctcaattcacagtgcccctctttgtttctggggtggaactaggtcctgagggcacagcctagctgagtgcaaagaaatataggatgcttagaaagcatacaggaggggccaggcgtggtggctcatgcctgtaatcccagaactttgggatgccaaggtggttggattacctgagatcaggtggattacctggtctcgagaccagcctgaccaatatggtgaaaccccgtctctactaaaaatacaaaaattaggctgagacaggagaattgcttgaacccaggaagcagaggttgcaatgagctgagattgcatcactgcactccagcatgggcaacaaagcaagactccgtcacagaaaaaaaaaaaaaaaagagagagagcatagaggagggttggccagccctgtggtgggtgggatgtcagagacacttcccagataaagtaagagttaaccctgcacctcaggtgtgatagtggggtcagtggtatgtgatccaggctggggagccagaggggagcaggtgccaactccacatccttctcctgtttctaggccctctcctcccttgtcggtttttggcggggaagctcagccttcgctgtggagggacgagagcacagagctcttcctcctggtggcctctgacccctgacggcctgtggcatcctccctagtcccctctgcccatccatccctctgttccaattctccactgctcccagcatgatctggggcatcttggcttctggtttcttttattattattattattattaattattgtattcctgtccttcacttttttcctccttagttcctgaaagtaaacaaaacaaaacaaaaacaaaaaaacaaacaacactttggttcctgatggctttctgaacccagccctgaccttgttgtttcacagctgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcc

SEQ ID NO: 132943 - DNA, 3701 bp, Homo sapiens
  Payload ID: 5976
  Gene Symbol: FAM83A
  Gene Name: family with sequence similarity 83, member A
  Uniprot ID: Q86UY5
  ENST ID: ENST00000536633
  CDS Start-End: 2015-3118
gatgacttggagaacagtcacttcctctttctgggctacagttttctcatcagtaactgaagagcttgcagtaccttcaacattccttcaggtgaggacttctctttgatcactgctatggtttgaatgtgtctcctaaagttcatgtgttggaagcttgatccccagtgcaaaagtgttgggaggtggggcctaatgagaagtaattaggccatgagtattctgccctcatgtattcatgagattaatgtcattatcatgggagcgggtttgttaaaatgagttcggccccttccttctctctctttcttctgccatacagtatgggatgcacagtgcagaaggtcttaccagatactggcaccatgcttttggacttctcagcccccagaaccatgagccaaataaatttctgttcattataaatcacccagtctgtggcatcctgttagagcagcataaatggactaagataatccctataaagagtggcaacagaacagttcccagctcactggcagaatcctatgatcaactagtaatgtctgccagggaaggaggatgagtggcactaacatgtacggtgtgtttgctcactgttctacaggattcaactagaatctctgggtctgtgtgaagaccaagagctgggaacagaagcagggctctagagggaaaagtttctttcggattccttttttttgttttgttttaaagagctgctctgtgagaagacaaggagaaaatggtccctacaggatactcacctctgtctcagggagacactcaagcatttattcaaccaagaaagagaattagttccaggtgaaaggagaaccccagaatacccacctacttttaaaattctcccctatgcatattcaggaaccaatcagaggatctgtaatgcgctgtgagtagaaagggaaggggaatgggaaagaaaaaagtgaagcttggaatggtggaaagtacatgggctctgccatttaccagctaagtgatcttgggcaagtaacttgacctttctgagcctcggtttcctctttggtgaaatgaggactaataatccatttctccctcagtacagacagccagcatgcagtgagcactcagcgatggccaagtatgggagaagccatgctggaatgaacatgtgggaccattttgtgcagtttctcagcgccaacactgactggtcccctgggctcgtgggccgccggcagcctcggctcgttctccagacagtgttccaagaagccacttccagcgaggaagcgttggcctgagaactggaacctctgcggtctctgcaaacacgacaatgacaaacacttgagagggcatgggagaaaggagctccttcatagggcagggaggggtgggcacttgggtgtgaccaaggagaggaggcgcgcctggtcaacagctctccctggcccgtgtccagctccctcctcacacagagaggggggcgcatctcagggatggcatctttcccccccacagggaaattcttatctttgaaacagcatgggaatcgaggcacccaggaggggagcagaggcaggcaggcctccttcaggcccatcctccagctgggctggtggtgccagggaggctccctgcttggtaacaaaggcctgagggagagttgcgaaacccagcaggaaagccggctcaccttcgcctccccctgcggctgggaggagaggaaatatcccatggctgactgtgccaaggaggtgtctgagccagccctcccggcccgagggcagggcaggtggccctgagagataagccaatcccgcagctgcagatgaggagttctgagaagcattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccgttcctgaaagtaaacaaaacaaaacaaaaacaaaaaaacaaacaacactttggttcctgatggctttctgaacccagccctgaccttgttgtttcacagctgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaagccac

SEQ ID NO: 132944 - DNA, 3167 bp, Homo sapiens
  Payload ID: 5977
  Gene Symbol: FAM83B
  Gene Name: family with sequence similarity 83, member B
  Uniprot ID: Q5T0W9
  ENST ID: ENST00000306858
  CDS Start-End: 117-3152
aaaccttcggcggccggcgctgtgcggcgggcgcggttgcgcgcggcttggggcaaatacttctcaccactgcatgaatggacatttgaaagtgccatagccaaacacttgcaagcatggagacctcatcaatgctttcctcattgaatgatgagtgtaaatctgacaactacattgagcctcactacaaggaatggtatcgagtagccattgatattctgattgaacacgggttagaagcataccaagaatttcttgtccaggaacgagtttcagactttcttgctgaggaagaaattaattatattttgaaaaatgtccagaaagttgcacaaagcacagcacatggtactgatgattcctgtgatgataccttatcttcagggacctactggcctgttgagtctgatgtggaagctccaaatcttgacttaggctggccatatgtgatgcccggactcttagggggcacccatatagatctcctttttcatccaccaagagcacatctacttacgataaaagaaactattcggaagatgataaaagaagcaagaaaggtcattgctttagtgatggatatatttacagatgtggacattttcaaagaaatcgttgaggcatcaactcgaggagtatctgtttacattctgcttgatgagtccaattttaatcattttctaaatatgactgagaaacaaggttgttcagttcagcgtctcaggaatattcgagtgcgaacagtaaaaggccaagattatctttcaaaaacaggggcaaaattccatggaaaaatggaacagaaatttttgttagttgactgccagaaagtgatgtacggttcttacagttatatgtggtcatttgagaaagctcacctcagcatggttcagataattacaggacaacttgttgagtcctttgatgaagaatttagaactctctatgccagatcctgtgtccctagttcatttgctcaggaagaatcagcaagggtgaagcatggaaaagccctctgggaaaatggcacttaccagcattcggtgtcttcattagcatctgtttccagccagagaaacctttttggtagacaagacaagattcataaactagattccagttacttcaaaaacagagggatatatactttaaatgaacatgacaaatataacataagaagtcacggatacaaacctcattttgttcctaactttaatggtccaaacgcaatacgtcagtttcaacccaatcagataaatgaaaattggaaaaggcatagttatgctggggaacagccagaaacagtgccatacctcctgcttaatagggctctgaatagaaccaataatccacctggtaattggaaaaagccatctgatagtctcagtgtggcgtcctcatcacgggaaggctatgtaagccaccacaacacacctgcccagagttttgccaatcggcttgcgcagagaaaaacaacaaatcttgcagacaggaattcaaatgttcggaggtcttttaatgggacagataaccatatccgctttttgcaacaacgaatgccaacccttgaacataccacaaagtcattcctacgtaactggagaattgaatcctacttaaatgatcattcagaagctacaccggactcaaatggatcagctttaggtgaccgatttgagggctatgataatcctgagaatttgaaggccaatgccctttatactcattctcggcttcgttcctctttagtatttaaacccactttacctgagcaaaaggaagttaacagttgtacaactggctcctcaaattcaactatcattggttctcagggaagtgagacacctaaagaggtcccagacacccctacgaatgtacagcatttgacagacaaacccttgccagaatcaatccccaagctcccattgcagtcagaggcaccaaaaatgcacaccttgcaggttcctgaaaaccactcagtagccttaaaccaaactacaaatggccatactgaatcaaataactatatatataaaaccttgggtgtaaataagcagacagaaaatctaaagaatcaacagactgagaatctacttaaaaggcgaagtttcccgttatttgacaactcaaaagccaacttagatcctggaaatagtaagcattatgtatatagtacacttaccaggaatcgagttagacaaccagaaaagcccaaagaagatttgctgaaaagttctaaaagcatgcacaatgtgactcataacttggaggaggatgaggaggaagttaccaagagaaactctccaagtggcactactaccaaatcagtttccattgctgctttacttgatgtgaataaagaggaatctaacaaagaacttgcttcaaagaaggaagttaagggttccccaagttttttgaaaaaggggtctcagaagttaaggtcattacttagccttaccccagataagaaagaaaatctatccaaaaataaagcacctgccttttatagattgtgtagtagctctgacacattagtttctgagggtgaagaaaatcaaaaaccaaagaaatcagacacaaaagttgattcatctcctagaagaaagcattcttcctcatcgaattctcaaggcagcatccacaagagtaaggaagatgtaacagttagcccatctcaagagataaatgctccaccagatgaaaataaaagaacaccttctccaggtccagttgaaagcaagttcttggaaagggcaggagatgcctctgccccaagatttaacactgaacagatccaataccgagattcaagggagattaatgcagttgttacccctgaaagaagacctacttcttctccaaggccaacgtccagtgagcttctacgatctcattcaactgatcggcgtgtttacagtcgttttgagccgttttgtaagattgagagctctattcagccaacaagcaacatgccaaataccagtataaatcgcccagaaataaaatctgcgactatgggcaacagttatggcaggtctagtccattgcttaattacaacactggtgtttatcgctcatatcaacccaatgagaacaagtttcgaggatttatgcaaaagtttggaaactttatacacaaaaataaatagctattaaaatgcaaa

SEQ ID NO: 132945 - DNA, 3145 bp, Homo sapiens
  Payload ID: 5978
  Gene Symbol: FAM83C
  Gene Name: family with sequence similarity 83, member C
  Uniprot ID: Q9BQN1
  ENST ID: ENST00000374408
  CDS Start-End: 98-2341
gcagaaggcggttctgctggtctcctcttcctgctgcagccagcccagcgtgcgggccatgggccctgccggcgggtgaggcagccgcgtggcaggcatgttcggaggcccggggcctggggtcctgggagcccagggcatggcgggacccctgcggggccgggtggaagagctgaagctgccgtggtggcgggagagctcaccgctggtgctgcggcacagcgaggcggctcggctggcggccgacgccctcctggagcggggtgaggctgcctacctgcgggtcatctccgaggagcgggagctgcccttcctgagcgccctggatgtggactacatgaccagccatgtgcgcgggggccctgagctcagcgaggctcaggggcaggaggcctccgggccagaccgcctcagcctgctctctgaagtcacctcagggacttacttccccatggcctctgacatagaccccccagacctggacctgggctggcccgaggtgccacaggccacaggcttcagccccacccaggctgtggtccacttccagagggacaaggccaagaacatcaaggacctgctgcgcttccttttcagccaggcccacacggtggtggctgtggtgatggacatattcactgacatggagcttctgtgtgacctcatggaggcctcaagccggcgtggtgtccctgtgtacctgctccttgcccaggagcacctgaggcacttcctggagatgtgctacaagatggacctcaatggggagcacctgccgaacatgcgtgtgcggagcacgtgtggggacacatactgcagcaaggctggccgccgcttcacggggcaggccctggagaagttcgtcctcattgactgtgagcaagtggtggcgggcagttacagcttcacctggctttgcagccaggcccacactagcatggtgctgcagctgaggggccgcatcgtggaagactttgaccgggagttccgctgtctgtacgctgagtcgcagcctgtggagggcttctgtggcggtgaggacccgctgtctccccgggcactgcgtcctccccctgtggccctagccttcaggcctgatgtcccaagccccacgtcgtccctgccctccagcaccagcctcagcagcatcaagcagtcaccgcttatgggtcgctcctcctacctcgctctaccaggaggtggtgattgcagtgatacgggtgtggtgtcctcgtccctgggtcctgcccgccgtgaggccagtggccagccctccctacatcgccaactgtcagaccctaaccacggctcccctcctgggctctatagggccaatctcggcaagctaggggcatacccatggtcccagtcctcccctgccctcaaccataatagtaccagccccttaaccttggcagtggggtcacctctgcttcctcgctcccggcccctcctccagttccatcggggtgccccagctctgtcccggttcccagagaatgggctcccaggaagccaagagcccagccccctgcggggtcgatgggtacctggcacaaccctggagacagtggaggagaaggagaagaaggcatctccaagtcagagccgtggccagctggatctccttgtccccttccccagagcccgagaagtgggagaccctgactctggggttacccccaactcaggcccccttcggcctggcgagcaggccccagaggacaggaggttgtccccaagccaggccgacagccagctggatctcctgtcccgagccctgggtactgggggtgcccctgagttgggttccctcagacctggtgatcgggccctggaggacaggaggctgtccctaaaccaaagccgtggccaatcagacctcctgatgcagtaccccaaggcccagggttccagagtgccccttgaaaccaactcctcagccagacctgccagacgggcaccagatgagcggcggcagaccctggggcacagccagctggacctcatcacaaagttcggcccattccgtggtgaggggcctgggcccaatggtctcccgatatcaagccctgctcgcacggctggagctgggtctggggatgagaaacggctaaccctgggccacagcaagctggacctcatcaccaagtatcatcagttgcacggggccaggcagggaactgagcctgggggtcccaagggtggccatctcaatggtggtaacagtgacctggtcagggatgagaaacggctgaccctgggtcacagcaaactggacctcatcactaagtacaacaagtccaagttcaagcagctccgaagccgctttgagtcctagccaaaggactggcatcgggggtgcactggcaagggcaggcccctcctctgtccaccgagactctggacttgctcaggtcccagactggggaagggaggtgtctagaaacccaggtcagacacactctctgggctcaagattcttgtgtacacacacacacacacacacacacacacacaccctaactagtatcttcttgaatctaggctgtgtttccagccctgtgctgggcctgtagagctgacaggtgggtcacactcagacctggggacagaggtgaaatgcacaagctgctggagaaggggtcagagccatatcaagttaaaggttaaccagttacagagggtgttagaaaacaaagggcagagagtcctggagaaggtggagtagtcagaaaactttcttagaggagatggaggtggcctttgagccaggccctgaaggatggggaggttttggacagagggaggagagagttagaaaaatttttggtagagagaatcaggtgaaagagatgccctaaagaggactgagtgggtctgaggtgaatgagtgaggaagagcagagtatgtggatacccggaaacacacacacacacacatcatcattatcatcatcatcattgtcgtcgtcatcatcttgctgagtcatcatcatcatcatcatcattgtcgtcgtcatcatcttgctgagtgtctcttgaagtacaggctgtgacaggttgtgggccattttcctgaactcaccacttacccgggatagtaaacatgatacacatcaataaaggcagactttattgtgaa

SEQ ID NO: 132946 - DNA, 2425 bp, Homo sapiens
  Payload ID: 5979
  Gene Symbol: FAM83D
  Gene Name: family with sequence similarity 83, member D
  ENST ID: ENST00000217429
  CDS Start-End: 42-1889
aaagcagccaatgggagagccgaggcggggaggtgcggccaatggcgcgggcctgtttgattcaaaggttgcctataaagcgggactgcacgccggtttttgtccgagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctcttt

SEQ ID NO: 132947 - DNA, 2475 bp, Homo sapiens
  Payload ID: 5979
  Gene Symbol: FAM83D
  Gene Name: family with sequence similarity 83, member D
  ENST ID: ENST00000619304
  CDS Start-End: 42-1889
aaagcagccaatgggagagccgaggcggggaggtgcggccaatggcgcgggcctgtttgattcaaaggttgcctataaagcgggactgcacgccggtttttgtccgagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaatatctgtgttcttagcattaaataaatataaacttgtgcttctgta

SEQ ID NO: 132948 - DNA, 2361 bp, Homo sapiens
  Payload ID: 5979
  Gene Symbol: FAM83D
  Gene Name: family with sequence similarity 83, member D
  Uniprot ID: Q9H4H8
  ENST ID: ENST00000619850
  CDS Start-End: 18-1775
cgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaatatctgtgttcttagcattaaataaatataaacttgtgcttctgta

SEQ ID NO: 132949 - DNA, 1926 bp, Homo sapiens
  Payload ID: 5980
  Gene Symbol: FAM83E
  Gene Name: family with sequence similarity 83, member E
  Uniprot ID: Q2M2I3
  ENST ID: ENST00000263266
  CDS Start-End: 191-1627
tgtcagaacagtgtggcaggggctgctgcagggagccatttggacatctgcagggccccgccggaggcctcggatggccacgtagggtctgcctatcaggagaacccccagatgatcacagtccccagagacagccagacccccggggacccagcctctcacagtcagtcctcccacccgagtgaccccgatggcggcctcccagctggcggcgctggaaggagtggactccggtcccagggtgcccggggccagccccggctttctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccaccgatgtggacgcgggcagcctgagctactggcctgggcagtcggagcagccggcgcccgtcctgcggctgggctggccagtggactctgcgtggaaaggcatcacccgggcgcagctgtacacccagcctcctggagagggtcagccgcccctcaaggagctggtgcggctggagatccaggctgcccacaagctggtggccgtggtcatggacgtcttcactgacccagacctgcttttggacttggtggatgctgccacgcgccgctgggtacctgtctacctgctcctggaccgccagcagctgcctgccttcctggaactggcccagcagctgggggtgaacccctggaacacggagaacgtggatgtccgtgtcgtgcggggctgcagcttccagagccgctggcgacggcaggtgagcggcaccgtgcgggagaagtttgtgctgctggacggcgagagggtcatctcaggatcctacagcttcacgtggagtgacgcacgcctgcaccgaggcctggtgaccctgctgactggtgaaattgttgacgccttcagccttgagttccggacgctgtacgcggcctcctgcccgctcccacctgcgcccccccagaaaccctcggtcataggtggcctgcagcggggccgcagcccgcaccgcgtgtcccgccgccgctccgtggcccccgcgtcgcctccgccgcctgacggcccgctggcccaccgcctggccgcctgccgcgtctcccctgctaccccggggccggcactcagtgacattctaaggagtgtgcagcgcgcccggacccccagcggccccccggcccggcccagccgctccatgtgggacctaagccgcctgtcccagctgtctggctccagtgatggggacaacgagctcaagaaatcctggggctccaaggacactccagccaaggctctgatgaggcagcggggcactggaggaggcccctggggggaagtggactcccgacctccgtggggcggtgccctgcccctgccccccgcccaccgcctccgctatctgtccccagcccgaaggcggttcggtggggatgctacattcaaacttcaagagcccagaggcgtcaggccgtcagactgggccccccgggcaggacttggggggcaaccctgaacaggagcccaagccaaatctgctggcccacccaaggagcagtgccggacaactgtcggctcagagccctctgcctcaatgccctgccttggacaaggcttctggcctcggcgtctgtcaagcagaagggatgtttgtcacttgttctgcaacttgggccgggagtggtggctcatgcctgtaatccctgcactttgggaggctaaggtgggagggttgcttaaggccaggagttggagaccagcctgggcaacatagtgagaccccatctctacaattaaaaaaacaaattagttggg

SEQ ID NO: 132950 - DNA, 565 bp, Homo sapiens
  Payload ID: 5980
  Gene Symbol: FAM83E
  Gene Name: family with sequence similarity 83, member E
  ENST ID: ENST00000593772
  CDS Start-End: 293-565
gaagccgggaagcaccgcagaagtagaagccggggagccacagcctacgttctcggaaaaagcaggcactggaagggaggccattgagcccggcactagccggtgtggccccggctttctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccaccgatgtggacgcgggcagcctgagctactggcctgggcagtcggagcagccggcgcccgtcctgcggctgggctggccagtggactctgcgtggaaaggcatcacccgggcgcagctgtacacccagcctcctggagagggtcagccgcccctcaaggagctggtgcggctggagatccaggctgcccacaagctggtggccgtggtcatggacgtcttcactgacccagacctgcttttggacttggtg

SEQ ID NO: 132951 - DNA, 15561 bp, Homo sapiens
  Payload ID: 5981
  Gene Symbol: FAM83F
  Gene Name: family with sequence similarity 83, member F
  Uniprot ID: Q8NEG4
  ENST ID: ENST00000333407
  CDS Start-End: 95-1597
gaggcgccccgcccctcggcggctccaggtgcggctgtgggacctcggaccgcggcggggccggggccagggccggggccggggccggggcgccatggccgagtcccagctgaactgcctggacgaggcgcacgtgaacgagaaggtgaccgaggcgcaggccgccttctactactgcgagcggcggcgggccgcgctggaggcgctgctgggcggcggcgagcaggcctaccgcgagcggctcaaggaggagcagctgcgggacttcctctccagcccggagcgccaggccctgcgggccgcctggagcccctacgaggacgccgtccccgccgccaacgcccggggcaagagcaaggccaaggccaaggcccccgcgccggcgccggctgagtccggcgagtccctggcctactggcccgaccgttccgacaccgaggtgcctcctctggacctgggctggacggacactggtttctaccgcggcgtgagccgggtcacgctcttcacccacccgcccaaggacgagaaggcgccgcacctcaagcaggtggtcaggcagatgatccaacaggcccagaaggtcattgctgtggtcatggacctcttcactgatggtgatatctttcaagacattgtggatgctgcctgtaagcgccgggtcccagtgtacatcatcctggacgaggcaggagtgaagtatttcctggagatgtgtcaggacctgcagctcactgacttccggattcggaacatccgtgtccgctctgtgacaggcgtcggcttctacatgcccatggggaggatcaaggggaccctgtcatcaaggttcctgatggtggacggtgacaaagtggccactggatcttacaggttcacctggagttcctcccatgtggacagaaacctcctcctgctcctgacaggacagaacgtagagccctttgacacggagttccgggagctgtacgccatctccgaggaggtggacttgtaccggcagctgagcctggcgggcagggttggcctccattactcctccactgtggctcgaaagcttatcaaccccaagtacgccttggtgtcaggctgccgccacccgcctggggagatgatgcgctgggctgcccggcaacagcgggaggcgggcggcaacccggaggggcaggaggagggcgccagcggtggcgagtcggcctggcgcctggagagcttcctgaaagacctggttacggtggagcaggtgctgccccccgtggagcccatccccttgggagagctgagccagaaggatggcaggatggtctctcacatgcacagagacctgaagcccaaatcccgagaggcacccagccgaaacggcatgggagaagcggcccggggggaggccgcccccgccaggcgcttcagcagcaggctcttcagtcgccgagccaagaggcctgcggcgcccaatggcatggccagctctgtctccaccgagacctctgaagtggagtttctgacggggaagaggcccaacgagaattccagtgctgacatctcaggtaaaacaagtcccagttctgccaagcctagcaactgtgtgatttcctgagctgcgggatggtggtgggcaggacgtgtggatgcctgcctgccctgccctgtgctgtggagagcgcaggtcgcacactgcaccagtttgcacatcagacgccaactggccttctgccctgcagcctccgtcctggcctcagggacgctggatcccaaatgagagggtccgaagcatctcagtcacacgcctccaccggactgtcggtggctgggcaggggtcagtgccacggcctccttgtttacatgaagtggaagcttgaccagtgtctgctcgcctttgtgccccaccccctccgctgattgccagatggggtgagggcccattctttaaacctttatggggtggggtgtctggggcagctgcagtggcttctcctttcccaggcttcctggtgcttctggttccccacgccactccccacccaagagattggtggaataaaagggaagagggcagggccctgagcctgggatcccaagttccagtctttctctagcctctgaactccagatgtaaggtgcagctggaactgcaggggcactggctgcagtggccttcctggccccatccctgcaggctcctgaactagacttgaatgagggtaagatcctgcggcctcccgcagtgggggcagaatttgacactgcttttctgagagcgctcgcactgaggtctctttttccctgcccagtgccgtcctggcagtctcggcatgggtggttgagacctccttggctgctgcctgctgcgggcctatgtgggggtccttacagggcctttacctgggactgctccttccctcagtcagtaaactttggtttacagcccaaggcagggagggagcttggctgagaggggattgggggtgtgggaggctgggccctgaggacaggagcatttgccttttctccctcaactctaacggggtcctcggaccccttcaccaaccagggcttccaggttacactttggccagactggcctttgcctcctgcgagagtcaggccatttttaggagcctgtgcctcgccagagcaggtcagcctaatggccatgaggctgagctgggaggcccagtaagcaattccattctgccttccccacttgggtgactggagagggccgaggagagtttgtgaatggacctgggagaaattgccaaactgcagactctgtgagccggccctgccggcagggcgatgggggatccaagccctgtggaagagccatgcagcggactttcttgccctctgacctctgaaccaaactctcatcctctttctttccttctaaaaaaccctaggacactaccagcacctgggggaggggtacagatgtctgcaaggcagctgatgtgagagcaagaaaaggggctgctctggctgggctgtgggagccaggcattgcttctgaggaagcaggaagtggggaccacatgtggcggccattgaggagatgcaatctctctggcagtggggaggggaagggaaaggaagggtgagcctgtccccagggtcttctctgttaatcccaaggctggcttctagggcgtgtggagaagggactctggcccacctccctgagcttttatgaaggtgaaatgcttctgggaagtgtttccttaggcaccaagaccaggcagtgtggcatgagctcattctggaggggagggaagggagagaggggggaggtgggatgtgggggtgttacacctcagctcgaggcggacaccttgaaggtatgggacatgaaatgtgtaaactgcaacgcggcaaagagatcactctctggtgtggagggtgggtgtctctggggattagggaggcagcctggggaagggaccggcctccaagcaagtcagccaagggcatctgtgcctcccctgccagaagagcaggccctgctttgtccctttacctcctctaggcccaaagcacacccaggtccctcccctgccctgacatctaatctgggaggatccctgattggaatctccaagtcaccacagccttgagccaggccttcctttctgcctcagtttctccatgtgccaagatggcgtttttcacactttcttggtagaaatgatggggagaccatatgttaggaagcaagttggcatagtgggaagagggccagccacaaggcaggagtgcccaggcagggtgcctctccctgctggcctgtgtcctcgtccttatagcagtgtggacaagatggtgtcggcaccccccgctccaaaaggcttgagacagaaactgtagtccgagatggcaaggattttgaactcacaaaatgcagctcttcatgtttgcctgtctgcctaggcaccggcccactctgttctgcctcttggcttctcagctgtgagtacgcctgccctctgttccagcacttgcacatactttgtgaagcagtctcttactcatcaaatctcaagggtacatctggccctcccagttggatggcaagttcaagggtggatcatgcccttggtccctgcacagcagcttctgcaaggctggttacattggaagggctctaggaggaacaggataaggcagcactctcggggctggggtctggcttcactgcacccccctcccaccccacaccaccaccaagctgctgtctttctgagtcagcttctgtagggtaagtgttcacagctggtgcagctctttgggaaacctaacctcccagtgagctgagcccctggtgcggccgccacgcttgcttctgccccacaagggcagtaagcacaggacttctggatggatctgggagcctgccccttgggatttggcaaaacttcccatctccttagctacctgtccttaatcttatccctgacccctcgagggctttcaagatagcctctgttaacatcactaccctctgcctgtgtagaactttatagaaaggctaggcaaaaaatgagacccagagatatggaagaaactggccaaagaggggaaagtgggctatttcttttttttttttcttttttttttctgagacagagtctcaccctgttgcccaggctggagtgcagtgacagcgatcttggctcactgcaagctccgcctcccgggttcacgccattcttctgcctcagcctcctgagcagctatgactacaggtgcccaccaccatgcctggctaatttttttatatttttattagagacagggtttcaccatgttagccaggttggtcttgatctcctgaccttgtgatccgcccgccttggcctcccaaagtgctgggattacaggccaccgtacccggccaggctatttttttgttttgtttttgtttactactgtattgcttttctctttttcatatttattgagcacctactatatgccagtcaccatgctagatgctttagtaacatgaaggtttcaaactaagaaaagctcaacaaagagccctttagaaaggtaacagttttcctgtgtattgggggagtgggtctcataaggttgtatgatgagaagcgcaagtaattgttttgttttttttttgagacaatgtcttgctctgtcgatcaggctggagtgcagtggcgtcatctcagctcgctacaacctccacctcctgggtttaagtgattctctggcctcagcctcctgagtagctgagattacaggcacgcgccaccacgcccggctaatttttgtatttttagtagagacagggtttcactatgttggtcaggctgatcttgaactcccggcctcaggtgatctgcctgccttggcctcccaaactgctgggattacaggcatgagccaccacgcccagcctggctaaggttcattatccccatctttcagatgaggaggcacacaactctccccagatcccacgtcacagagaatgcaggtctgagtctgttccttgagctcagggtcttggcaatggtgatgctttggagctgcagaatcctctgttggggatggggctgccctgtgcattatagtacgtttagcaacatccctagcttccacctactaaatgccactagcactccttcagatgagaccaccaaaaatgtctccagatgttaccacatgtcccctggggggtaaaagtgcccccgttgagagcactggctcttttcttcacagtcctgacctggtggcctgcacaggccacttctccgaagtgtttcaatgcactctctgccctgggtaccttggacacagcaccctggcccagagaggttggctgacttgcctgagacgctgcttcctgggagacgcagtagcatctttcctttctgttctggttatctttcttagttctttaccaccttatattccccatgacaggtgtgtttatgtacacacatctgcctcactccactcagctccctgtcaggtttcctgccagtctgtccctcttccttcaggctcagctacgtcctgcacagacagtaccactgcacatacctgtgtgtgcccagcggtggacccacctccaaaagcagccagtgctgacagcagagagccttccacactcaagtcaggccaagcaggaatcgctacctgcctgtcatgaccacattctcagtgaacattgacaaagcccccttagcagctaattagccctgccgtgcgctagggatgcaatttctcatctggcagtgcgccacactcctgcctccctgcccaaaggacgtagtggctgctgctgatcgtctgcactgctgttccaggggcaggaggtttgctgcaaatcaggtacccccagctcagtgagcagaaccagtccaaggttgagtgaggagaagggcaagaagggcaggcacagccgtgagtatgttctggggctaagtaaccatgagatcagcccagagaccttgcacagttaggcaggcctggacttctcgcccttccccttgcagcttctgctctcccagctagggactgaggaaagccctgcttctagatgccatgtgctgctgcctggcacgataggtacccatctgtccttggggttcctgagcctggagagcgggctttgtgagcactggtgcctcacctgcctggctcagctctgcagccacaatatatgcttaatacctatttgttaaatgattgaagacttgactgccattcagtacagagaattagccaggtgaataaacaggatgtgtcatagaggttctagaattgatcatgaccctttctgtctcattcctgacttctaataccgtatatgccaaatggggttctgctgtgatttaatttcttaaggactgggtttatcaaaagtccctcctgatctaatcctttcctctaggaaggcttctcctttcttcatctgtcctaagtgcatggtcttcatctcctgggtggtccagactaggtggcactgggcctgcaggcctctagctgctcaaggatggccctgtctgcatgcttcctttcaaaagctagcatagaaaggagggcccaaggtgaggaaatttgtccaaagtcacccaatgagtcgcaggaagggctagaatctggttatctggaccgtcctagagcactttcacagtgacagccggctggaatcaagttttcatttagaaaaatggctagaagttagggcattgcctgcagccactgaaaagcagctttaggagcagatgtccacgtaatagaaggagatgggctagggcctgccacggaagccagcaagcgcgtgggagctgggggaggaaaggagcaaaaggcaagaacaggcagtatgtccgcggtgcccacagtgctgtgggtacaagcaaggggaaaagagcccatggtgtgcagaaaaccatgcgtcatgattcttatttcctgctcgcagctttgactctctgcctcatctcttcctggaagtgtcttggaagttaggcgactgcacagggaaaggttcgctgcagtgcttgcaggcctgcacccatttattcatccggtggatatttgctgggtgcccggcctggggatccatggtgagcgaggaaggcatggtattgaagtggtatgcctgcatgaccttggcgggggcgcatggcatagagaggacaggcttcagaacaggcaggcaagggctgaaatcctatctctgccaccgaacagctaatgaccccagcaagcaatttcacatccccgaactttcctgtttcctcatgtgtcaaatggggatgatctcgagacgactctccagagtaaccacgtgaagcacctagcacaggggctgacgcaaacagctgggcatcggaggagcctccagggttgtgacctccagtggcttattttccttttgggatcttctctcctagatcctcccctttaattccctgtgaaatttaccactttcatattgaatcgttggcacacagggctaactgcttgttcacctgaaggaagctacagagttcaggtttcttttttctttctttctttcttttttgcttttttaagatgatcttgctccgtcacccaggctggagtgcagtggcgtaatcatggcttcctgcagcctcaaactcctgggctcaatgagttccttgagatcttccatcctcagcttcccaagtagctagtagtagtagtggcttgcaccaacgctcctgccctaattttcaatatttttttgtagagataggatctcactgtgttacccaagctagacttgaactcctggcctcaagcgatccttccgccttggcctcccaaagtgttgggattacaggcattagctaccacacctggccaaggcccaggtttcgacagaaagggagagaaaacctgccagagatgccatttcggagccactctgcttggcagggacctgtgttcccctcatgcaggttcatccttagagggctgcggtcttatctggttgtgcaaaagtcccacaacctttctggattgatagtttgtggtgaaataaacaattttagtttgtttggagaatcttttgtatacaaaatacaaataaaacctaaatcaaagaaacagagcatgtccggagaagtctgccaacccttctccaggccatggggcttcccaagccaggcctgtactcctcatgtagattccacaccccgccttgatgtctttggctttcacactagtgactatagcctggtgggacggggtctaggggccacagtcctggtcctgcgcaggtggccctggagagaagccttggagaacttggagaagcccacgcggctggcagcatcatggtgagaggctgacaccttgtggctggctggcagcatacgtccttcctcccctaggtcagctagacggccaaagcagggatctgcaagctccttctgtggcgggccaaaaagtgaacattcagtgtgtctgttgcagctactgtcatagcactgaggcacccctagacagtacagaaacaagcaggtgtggccatgttccagtgaaaccttatgaatactgaaatctgaatccataattttcatgtatcacaaagtagtaatattcttttaatatgcaaaaaccggccaggtgcggtggctcatgcctgtgacctcagcactttgggaggccgaggtgggtggatcacctgaggtcaggagttcgaaaccagcctggccaacgtggtgaaaccctgtctctattaaaaatacaaaaattagcctggtgtggtggcacatgcctgtaatcccagctactcgggaggctgaggcgtaggaattgcttaaacctgggaggcggaggttgcagtgagctgagatcatgccactgcacttcagcctgggcaacagagctagactccatctcaaaaacaaacaaacaaaaaaacaaaagcaaaaaccagtcttagctcacaggctgtgccaaaacaggcagtgggctggatttggtcctcaagcctgggcttgctgacctctggcctaggacacctctcctttatgcctccgctcccaacacggactctcaactctcatgtttaccttgtcattgttctgtcaagaggaattcactagtctcactcctccaaccagaccgctgccactaaggcttcttctgaacagaaattctggatttgttctcacccatttcataaatgtacataagcacccatcaggtgccaagccctgtgctgagatgcctgcagagcccagagttttcaccaactttttttttaagagatgggggtctctgttgccaggttggagtgcaatgacataatcataactcaccgcaacctcaaactcctaggttcaggtgatcctcccgcctcagcctcccaagtagctgggactacaggcatgcaccaccctgcccagctaattaaaaaaaaaactttagggatggggtcttgctatgttgtctaggctggtctctaactcctgggctcaagtgatcctcccacctcagcctcccaagtagctgggcttacagatgtgagccactgcacctgctcaacatttaattttttcattcattcattcgttcattcatttgttcaaacgaacttattgagaacttactgtgttccaggcactgtgataagatagacctggcctttaccttcaaatgttcagaacatggttaggaagatggatactgggaggcaagtgttctgatgggaaagcacagcatgtaaagaagcccagaggaggcacttaacctgggggagaagaacagggtaggcttcctggaggaggaggtaatctctgagccgatacctgaggagtgaatggaggaggggacaatgaggcaaggcattccagggaaaggtccagagcctagacagaactcttttaggagaattatgagaatcacaattatcgaggacacagtgaagactcagataactcaaatataggttttgcccgcaaagccttcctgtctggtgggtgagacagtctacagcaagctgctccaaggatatggagaaaaaagtttttcctctggccttgtaggattggttattactgagcctggagtacgcaaaggccagcgagtgctcctaaggcagggagggggctgccttcactatgggtgctcaggaaatctgccaggggaagggagatgtgggcctgcctcggctgcagaaacccctcagaggaggaggaggggcttgaactgagctttgaagaaagtgtagacttggggacaggcagaggaagagggggcatcataggcagcagaaaccacatggacaaactctctgccggagaatgggcatggccgggctgaggggtccctggacaggaaccagccttccctatgcacctgcacccgtgagtctcacaacagccccaacaggcaagtgttattttcctcaattctaccaattaaaaactgaccttgggcaactgcttaacctatctctgccttactttcttcatctgtatctacctcagaaagttactatgaggactgaataagctcatacatatacaatgcttggagcagaggctggtactagagctggcttcatgggcatgaaacctgtgaacacagaaccccatgctttcattttccacttagtcctgcctggcatagtatgcagtttttttaatttgagatggagtctccctttgttgcccaggcttgagtgcagtggcgcgatctcagctcactgcaacctccacctcccaggttgaagcagttctcctgcctcagcctcctgagtagctgggattacaggtgcgcgccaccatacccagctaatttttgtatttttagtagagatgaggttttgccattttggccagcctggtcttgaacctctgacttccatgatccacctgcctctgcctcccaaagtgctgggaggattacaggcatgaaccactacgcctggcctggtatgtgggttaaaatgttaggttttatcattatcttaggtggagaataacaaatccgattcaatatattcattttagaaacgaggaaactgaagcttagatagtttgtgtgacttgcaaaaagtcacgcagcaaacaagctgcagaatgaagggtggagatggagagatagaattctcatcttagaggtgaaagtaggataatgacccagctgagcttgctgagtcctgcgagcgtcgcacgcccccagagacaacataaggagagaagtgcagacagattcctttgaaggagcttagagaaagagatggtagggaaaagagcatgaacagttgtagaggtaggaggaaagctggctatttggggaagcaaagaaaagattctcagagtaaaacgtattggtgaagccatggaaacaaggactgagaaagtctcttggatcttggccacaaaaaggttatagatgagcttagagaaatgaatttcagtagagttagggctagaagccaggttcagagagagaaaacgagagagcattcctggtggtggagatggccgcaggccattatttaaaaagctaggataagaaaatagagaagaaagggaaggaagctatttgaagggagtgggagaaaagccagatctcagttgggacgtggaggaaggaccaccagaggcagtaatttagccggaaagaggtgtatttctttccttgagtttatagggggtaaagaggatggggctgagatactaaagactacgaggacaactgttcattgagggctggtcatctccccagctgcactgtggggttcccaagtcagacatcccagaggcaatatagcagcgtggacaagagcttactcgttggagtcagaccgcctaggttcaacgatgggttagttagcccttcagtgcctccattttcctatctagaaaatgtggataacaatggttgttgtgaagattaacagccataatccacgtaaagccctcagtacagtgtatgacacacagcaagtgtccaccaaagggtagttattattaaccataatcctggttctcttgtgagctgcctcctgtgtgtctagcattggccagcacacatgagggggtccagtgtttgctgcttaactaagtagcttctcaggaagtgtggtcataaaaaatgataggtgatttagaaggtgagacagacacaagggatgtgttgcacagtaaatgctcccagacatgcaataaatgcttataagcatgccctctgtaatcagccctctttagagagtttccctgcctcattgctcttggtctttggcaatggctacacccactgcccaagcaagcagtatcagctgtcagctgtccccttgtcttttggatcagattcctttacagggatcttcccattgttataagcttcaagaattggagaatgcttaatgaacacttccaaattcttcatagctatgaggggccagtgcaaagggcggaaggagttcttctgtgtcacagaaattagagctggagcagatccagcttgctatccccccttcccccagcttgtgggttattgcagaattgttcacaaaaattcccattgccttggaatttgtccaagccgagggcagggatcacaacacaacctctcaagggaaaaaaggaaggcctgttgcttgagatggctcagagcacttttggtagccagccaaggcagctatcactcatgaaatctgccttcccctccagcaaaaagccaactgtatagaacaccacatatagagcgctaagaatagcacagcgctccaagaacatagtgcacttggcctgcatacaagtgtgcagggcttaacgagtctttttactctgaaagctgggtgggttggaacaaacaaacagaaaaatattttccccaagtagcatgcagagaggaaatgagagcaagcacaagagagcaccctggcatagcattctctgacctgggctgccttttcagggtatgagttgattccgcaggcaccaaggcatgcctgtaagccctacagggcagacgccctcaccccaatcattggcttaacattcacaccaggctgagtaagccccaaaagtcctgccattggctctgacaggaattgaaacccatcttctccacaataaatatttgattgacagattggcttccttcctataagtatagaaagcgagggcaggttccatccaaagccgcagttctgggtgatgagagctctgagagcccagaaaagaccctgaaccacatcccactgtttgttggaagaagaaactcatttgtgggtctgttcataaaagagtctgggaagatagtctccttaacagtgtctggatgtaacagactatgggcggcttttactttataactttctatattgtctgaaatacagaatattaaatattgagttaatattatatttactcaatgttactttttttttttttgagacagggtcttgctctattgcccaggctggagtgcagtggtgtggctcactgcagccttgaactcccaggctcaagcaatcctcccacctcagcatcccaagtagctgggactgtaggcgcaggccaccatgcgcaactatttattttctttctttttgtagaaatgggctctgcctgtgttgctctagctagtctcaagctcctggcctcaagcaatccttccgccttggcctctcaaattgctgggattacaagcataagccaatgtgcctggcctcaatgttacttttatgatcagaaaaacggccatcttatttggaaattattttcctattctcaagtgggcaaataggagaaggtttcaggcatttgttttgtctctgggagggaaggcacaatgaggtggagtggacaaattgctgaggcctttatggacaaagattctaagaagaacaggctttggccatctctggatattcccattctgctccctgccaccagagagcaaatgtcgtaggtcaccacacatcaccagtctcttgcctagctaaccgtaactcattctttagttctccttgaaggtgtcacttcttccaggaagccatttctgtccctcccgagatggagtcccatgtccctaccatttgcttccagggcaccttctcacagcactgcatcatggttatctgcttatctgctggacacccctactcgactgaggtccttgaaggaagagagagtgtatcactcatctgcatagcctttgtaacttagtaaaagtgcctgacatgctcactaaacatttactgagtaattatttatttgggggccttttacgatcagaacaatgtgaaggacacaaagatgaaaaagaaaccatctgcttcaaggtacttacaactgaaatgtatcaaacaattacccagaaagtcaagcaccaacttaagtgctaaaataggggtccaagcaaccaactttgaagattaggaaggttttagattctgaatgtttctcattcattgtgtttttgagttcagaatccccatactggaaggctaatatggggtatgtgcatacaattttaaggactcacgttcttacaacctatattagaatttgacgcacgatctttcttctgtccttcttgcagttgccctaggaatacatgccacttactcttaattgacgtttatgaaataccttggcttcatttgctgaaaggctctaagtgttgagcattgttactatgttacaatggttgttttattattaaagcagtgccaaggaggttacacaacagcttggatcaggaagtgaaacaagggcggtgatcccactgaagctacaggggatggggatttgggacggtaaaatgttaattacccaagatggaatgtgggctagagtccagcgttgtgctcctggagatcatttcggtcgcaaaagctcactggcaatgggtcctaagcgtcctgccctcctctggctgaaatgttggattcacttcgatgaatgctgctatagggaaagaacccagtggccaccagccaggagcacacgtcttgctcagcatcaactatcctggaagatttccaggagctgaagggctgttctctttgcatgcaataaattattcatttctaa

SEQ ID NO: 132952 - DNA, 1917 bp, Homo sapiens
  Payload ID: 5981
  Gene Symbol: FAM83F
  Gene Name: family with sequence similarity 83, member F
  Uniprot ID: Q8NEG4
  ENST ID: ENST00000473717
  CDS Start-End: 453-1451
ggggagtgcctgtgtggctgagggacacgtccaagctgcagtcggctctgtggttgtggacacctggcagagccatgccttctctagtctgggtcatccaaacacacgtggggtgcaggggccaggtggagccctcttgtcgtttttgttatctaacggtaattacggagtccagaaagagaattggaaatgccggcagtttaattaaagctgaatggcaggagaggggcatttggaggctccctccctgccttcactccccgtcctgccgcccaggcaggatgtcagatgaggagacgttgagctcatcaaacacccaatgagaagtcttacaacatcagaagctgtctgccaatgcgcctgcgacagcttatagaaactgctgccgcctcgaatcaacctctctccccaggcattgcacgtcagtaggtaaccaggtcattgctgtggtcatggacctcttcactgatggtgatatctttcaagacattgtggatgctgcctgtaagcgccgggtcccagtgtacatcatcctggacgaggcaggagtgaagtatttcctggagatgtgtcaggacctgcagctcactgacttccggattcggaacatccgtgtccgctctgtgacaggcgtcggcttctacatgcccatggggaggatcaaggggaccctgtcatcaaggttcctgatggtggacggtgacaaagtggccactggatcttacaggttcacctggagttcctcccatgtggacagaaacctcctcctgctcctgacaggacagaacgtagagccctttgacacggagttccgggagctgtacgccatctccgaggaggtggacttgtaccggcagctgagcctggcgggcagggttggcctccattactcctccactgtggctcgaaagcttatcaaccccaagtacgccttggtgtcaggctgccgccacccgcctggggagatgatgcgctgggctgcccggcaacagcgggaggcgggcggcaacccggaggggcaggaggagggcgccagcggtggcgagtcggcctggcgcctggagagcttcctgaaagacctggttacggtggagcaggtgctgccccccgtggagcccatccccttgggagagctgagccagaaggatggcaggatggtctctcacatgcacagagacctgaagcccaaatcccgagaggcacccagccgaaacggcatgggagaagcggcccggggggaggccgcccccgccaggcgcttcagcagcaggctcttcagtcgccgagccaagaggcctgcggcgcccaatggcatggccagctctgtctccaccgagacctctgaagtggagtttctgacggggaagaggcccaacgagaattccagtgctgacatctcaggtaaaacaagtcccagttctgccaagcctagcaactgtgtgatttcctgagctgcgggatggtggtgggcaggacgtgtggatgcctgcctgccctgccctgtgctgtggagagcgcaggtcgcacactgcaccagtttgcacatcagacgccaactggccttctgccctgcagcctccgtcctggcctcagggacgctggatcccaaatgagagggtccgaagcatctcagtcacacgcctccaccggactgtcggtggctgggcaggggtcagtgccacggcctccttgtttacatgaagtggaagcttgaccagtgtctgctcgcctttgtgccccaccccctccgctgattgccagatggggtgagggcccattctttaaacctttatggggtggggtgtctggggcagctgcagtggcttctcctttcccaggcttcctggtgcttctggttccccacgccactccccacccaagagattggtggaataaaagggaagagggcagggccct

SEQ ID NO: 132953 - DNA, 2929 bp, Homo sapiens
  Payload ID: 5982
  Gene Symbol: FAM83G
  Gene Name: family with sequence similarity 83, member G
  Uniprot ID: A6ND36
  ENST ID: ENST00000345041
  CDS Start-End: 167-2638
gcccccgccgcccctccccgcgcggcccgccctccccgattgctcatgggcagagaagcagaggccgcggagaggcccccgagcgcgcggtgccccagctgggccggagctaggagctggaccttgcccacccacccccggcagcagtgcccgggcaggcggcgccatggccttctctcaggtgcagtgtctggacgacaaccatgtgaactggcgctccagcgagtccaagcctgagttcttctacagcgaggagcagcggctggcgctggaggccctggtggcccgcggccgggacgccttctacgaggtgctcaagcgggagaacatccgagacttcctctcggagctggagctcaagcgcatcctggagaccatcgaggtgtacgacccgggctctgaggaccctcggggcacgggcccctctcaggggcccgaggacaatggggtcggcgacggcgaggaagccagcggggcggatggggtccccatcgaggccgagccgctgccctccctggagtactggccccagaagtcggaccgctccatcccgcagctggacctgggctggcccgacaccatcgcctaccgcggcgtgacccgggctagcgtctacatgcagccccccatagacgggcaggcccacatcaaagaggtggtgcggaagatgatcagccaggcacagaaggtgatagctgtggtcatggacatgttcaccgacgtggacatcttcaaggacctgctggacgccggcttcaagaggaaagtggccgtgtacatcatcgtggatgagagtaacgtcaagtacttcctgcacatgtgtgagcgggcctgcatgcacctggggcacctcaagaatctcagagtgcggagcagcgggggaactgagttcttcacgcggtcggcaaccaagttcaagggtgccctggcccagaagttcatgtttgtggatggagaccgggctgtgtgcggctcctacagcttcacgtggtcggccgcgcggacggaccggaatgtgatctctgtgctgtctggccaggtggtggagatgtttgaccggcagttccaggagctgtacctcatgtcacacagtgtgagcctcaagggcatccctatggagaaggaaccggagccggagcctattgtgctgccctctgtggtccccctggtgcccgcgggcactgtggccaagaagctcgtcaaccccaagtacgcacttgtcaaggccaagagcgtcgacgagattgccaagatctcctctgagaagcaggaggccaagaagcccctggggctgaaaggcccagcgctggctgagcatccaggggaactccccgagctgctgccacccatccacccaggactgcttcacctggagagggccaacatgtttgagtacctgcccacgtgggtggagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggaggga

SEQ ID NO: 132954 - DNA, 5266 bp, Homo sapiens
  Payload ID: 5982
  Gene Symbol: FAM83G
  Gene Name: family with sequence similarity 83, member G
  Uniprot ID: A6ND36
  ENST ID: ENST00000388995
  CDS Start-End: 225-2696
agcggggcggccctgagtcaccggcgcgcccccgcccagcctcgcgccgccgccgcagccgccgcgtgtgcgccccgctccgccagcgcccgctcgattgctcatgggcagagaagcagaggccgcggagaggcccccgagcgcgcggtgccccagctgggccggagctaggagctggaccttgcccacccacccccggcagcagtgcccgggcaggcggcgccatggccttctctcaggtgcagtgtctggacgacaaccatgtgaactggcgctccagcgagtccaagcctgagttcttctacagcgaggagcagcggctggcgctggaggccctggtggcccgcggccgggacgccttctacgaggtgctcaagcgggagaacatccgagacttcctctcggagctggagctcaagcgcatcctggagaccatcgaggtgtacgacccgggctctgaggaccctcggggcacgggcccctctcaggggcccgaggacaatggggtcggcgacggcgaggaagccagcggggcggatggggtccccatcgaggccgagccgctgccctccctggagtactggccccagaagtcggaccgctccatcccgcagctggacctgggctggcccgacaccatcgcctaccgcggcgtgacccgggctagcgtctacatgcagccccccatagacgggcaggcccacatcaaagaggtggtgcggaagatgatcagccaggcacagaaggtgatagctgtggtcatggacatgttcaccgacgtggacatcttcaaggacctgctggacgccggcttcaagaggaaagtggccgtgtacatcatcgtggatgagagtaacgtcaagtacttcctgcacatgtgtgagcgggcctgcatgcacctggggcacctcaagaatctcagagtgcggagcagcgggggaactgagttcttcacgcggtcggcaaccaagttcaagggtgccctggcccagaagttcatgtttgtggatggagaccgggctgtgtgcggctcctacagcttcacgtggtcggccgcgcggacggaccggaatgtgatctctgtgctgtctggccaggtggtggagatgtttgaccggcagttccaggagctgtacctcatgtcacacagtgtgagcctcaagggcatccctatggagaaggaaccggagccggagcctattgtgctgccctctgtggtccccctggtgcccgcgggcactgtggccaagaagctcgtcaaccccaagtacgcacttgtcaaggccaagagcgtcgacgagattgccaagatctcctctgagaagcaggaggccaagaagcccctggggctgaaaggcccagcgctggctgagcatccaggggaactccccgagctgctgccacccatccacccaggactgcttcacctggagagggccaacatgtttgagtacctgcccacgtgggtggagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtgggactgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttcccaaaa

SEQ ID NO: 132955 - DNA, 426 bp, Homo sapiens
  Payload ID: 5982
  Gene Symbol: FAM83G
  Gene Name: family with sequence similarity 83, member G
  ENST ID: ENST00000580115
  CDS Start-End: 1-426
aggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacaggacaaggtcccagaaccctgggtgccctgcagcctgggttcagtgcccggagcccgtcctacctgggaacaatgcgcggctgatcatgcccggcatgatgatcaggcccatggggagcatc

SEQ ID NO: 132956 - DNA, 5654 bp, Homo sapiens
  Payload ID: 5983
  Gene Symbol: FAM83H
  Gene Name: family with sequence similarity 83, member H
  Uniprot ID: Q6ZRV2
  ENST ID: ENST00000388913
  CDS Start-End: 127-3666
ggccgggcgggccgcggcagggagtggctgccggaccgaccggaccgcgaggccgctgggcggcggtcggctcctgctgcccctgtgccgagaccccgcgcacctggccaggcccctggccccaacatggcccgtcgctctcagagctcctcgcagggggacaacccactggcacccgggtacctgccgcctcactacaaagagtactaccgcctggcggtggatgcactggccgagggtggctcggaggcctacagccgcttcctcgctaccgagggggcaccagacttcctgtgccctgaagagctggaacatgtgagccgacaccttcggcctccgcagtatgttacccgagagccacctgaaggcagccttctcgacgtggacatggatggctcctcgggtacatactggccagtgaactcagaccaggccgtgcctgagcttgatttgggctggcctctgaccttcggcttccagggcaccgaggtgaccaccttggtgcagccaccgccccccgacagccccagtatcaaggatgaggcccgcaggatgatccgttccgcccagcaggtggtggccgtggtgatggacatgttcactgatgtggacctgctcagcgaagtgctggaggccgcggcccgtcgggtcccagtctacatcctgctggatgagatgaacgcgcagcacttcctggacatggccgacaagtgccgtgtcaacctgcagcacgtggatttcctgcgcgtacggactgtggcgggccccacctactactgccgcactgggaagtccttcaagggccacgtcaaggagaagttcctgctggtggactgtgccgtggtgatgagtgggagctacagcttcatgtggtcctttgagaagatccaccgcagcctggcgcacgtgttccaaggagagctggtctccagcttcgacgaggagttccgcatcctcttcgcgcagtccgagccgcttgtgccctcggccgcggccctggcccgcatggacgcctatgccctggctccgtatgccggggccgggcctctcgtgggcgtccctggggtcggggcgccaacccccttctccttccctaaacgagcgcacctcctgttcccgccaccccgggaagagggcctgggcttcccctccttcctcgacccggaccgccacttcctgtcggccttccgccgggaggagccgccgcggatgccggggggcgcgctggaaccgcacgcggggctgcggccgctctcgcggcgcctggaggccgaggccgggccggctggggagctcgcgggcgcgcggggcttcttccaggcgcggcacctggagatggacgccttcaagcggcacagcttcgcgaccgagggcgcgggcgccgtggagaacttcgcggccgcgcggcaggtgtcgcggcagacgttcctcagccacggcgacgacttccgcttccagaccagccacttccaccgtgaccagctctaccagcagcagtaccagtgggacccgcagctcacgccggcgcgcccgcaaggcctgttcgagaagcttcgcgggggccgcgcgggtttcgcggacccggatgacttcaccctgggcgccgggccccgcttcccggagctcggacccgacgggcaccagcggctggactacgtgccgtccagcgcgtcccgcgaggtgcgccacggctcggaccccgccttcgcgcccggaccccgcggcctggagcccagcggagccccgcgccccaacctgacccagcgcttcccatgccaggccgcggcgaggccgggcccagaccccgctcccgaggcggagccggagcgcaggggcgggcccgaggggcgggcagggctgcggcgctggcgtttggcctcctacttgagcggctgccacggcgaggatgggggcgacgacggcctaccggcgcccatggaagcggaggcttacgaagacgacgtgctggctcccgggggccgggcacctgccggcgacctgctcccctcggccttccgcgtcccagcagccttccccaccaaggtcccggtgccaggcccgggcagcggcggcaacggcccagagcgcgagggcccggaggagcctggcctggccaagcaggactcattccgctcgcgcctgaaccccctggtccagcgcagctccaggctgcgctcctcgctcatcttcagcacgtcacaggccgagggcgcggccggggctgcggcggccactgagaaggtgcagctgctgcacaaggagcagacggtcagcgagacgctggggcccggcggagaggccgtgcgctccgcggcttccaccaaggtggcggagctgctggagaagtacaagggcccagcccgtgatcccggcggcggcgcgggcgccatcaccgttgccagccacagcaaggccgtcgtgtcccaggcgtggcgggaagaggtggcggccccaggtgccgtggggggcgagcgccgcagcctcgagagctgcctgctggacctgcgcgactcctttgcacagcagctgcaccaggaggcggagcggcagccgggagccgcgtcgctcaccgcggcgcagctgctcgacacactgggccggagcggctccgaccgcctgccttcccgcttcctctctgcccagagccactcaacgtccccgcaagggctggacagccctctgccgctggaagggtccggagcgcaccaggtgctccataatgagtcaaaagggagccccacctcggcttaccctgagcggaaggggagccccacgcctgggttttccactcgaagaggaagtccaactacaggatttatcgagcagaaggggagccccacctcagcctaccccgagcgcaggggtagtccggtgccccccgtgccggagcgcaggagcagtccggtgccccccgtgccggagcgcaggggcagcctcacccttaccatctccggggagtccccgaaggccgggcccgcggaggaggggccgagcggccccatggaagtcctgcgcaaaggctccttgcgtcttaggcagctgctgagccccaagggcgagcggcgcatggaggatgagggtggcttcccagtgccgcaggagaacggccaacccgagagcccgcggcgtctgtcactgggccagggtgacagcacggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagaaagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatctgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagacctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcgcctctgtgcctcaattcctcattctctgggcccttctcctcctcagggcctcctgttctcagggcctcccccctccccgctccctccctctctcaaggtctcctccttccctcccccccccccccccccgtctcccccctcccccgcctgggcttcacttcctttcctacttggattctcctgctcgctgcctcccagcatcttttttggaggcccgtctcttgctgtggggaagactgggctggctgcgggcagtttgcaaggggtgggtggggcaggggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcattggcctttgcagcacagtaaaacatggtccagacaacctgtggccccggcctcatgagcaccccctgcacaggcccggcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta
